US012624356B2

(12) United States Patent
Freier

(10) Patent No.: US 12,624,356 B2
(45) Date of Patent: May 12, 2026

(54) COMPOUNDS AND METHODS FOR MODULATING PLP1

(71) Applicant: Ionis Pharmaceuticals, Inc., Carlsbad, CA (US)

(72) Inventor: Susan M. Freier, San Diego, CA (US)

(73) Assignee: Ionis Pharmaceuticals, Inc., Carlsbad, CA (US)

( * ) Notice: Subject to any disclaimer, the term of this patent is extended or adjusted under 35 U.S.C. 154(b) by 0 days.

(21) Appl. No.: 18/341,512

(22) Filed: Jun. 26, 2023

(65) Prior Publication Data

US 2024/0209364 A1 Jun. 27, 2024

Related U.S. Application Data

(63) Continuation of application No. 17/362,567, filed on Jun. 29, 2021, now Pat. No. 11,732,263.

(60) Provisional application No. 63/124,476, filed on Dec. 11, 2020, provisional application No. 63/045,740, filed on Jun. 29, 2020.

(51) Int. Cl.
*C12N 15/113* (2010.01)

(52) U.S. Cl.
CPC ........ *C12N 15/113* (2013.01); *C12N 2310/11* (2013.01); *C12N 2310/315* (2013.01); *C12N 2310/322* (2013.01); *C12N 2310/3341* (2013.01); *C12N 2310/341* (2013.01)

(58) Field of Classification Search
CPC .............. C12N 15/113; C12N 2310/11; C12N 2310/315; C12N 2310/322; C12N 2310/3341; C12N 2310/341; C12N 2310/345; C12N 2310/346; C12N 2310/3525
See application file for complete search history.

(56) References Cited

U.S. PATENT DOCUMENTS

| | | | |
|---|---|---|---|
| 3,687,808 | A | 8/1972 | Merigan et al. |
| 4,415,732 | A | 11/1983 | Caruthers et al. |
| 4,469,863 | A | 9/1984 | Ts'o et al. |
| 4,476,301 | A | 10/1984 | Imbach et al. |
| 4,500,707 | A | 2/1985 | Caruthers et al. |
| 4,725,677 | A | 2/1988 | Koster et al. |
| 4,845,205 | A | 7/1989 | Huynh Dinh et al. |
| 4,973,679 | A | 11/1990 | Caruthers et al. |
| 4,981,957 | A | 1/1991 | Lebleu et al. |
| 5,013,830 | A | 5/1991 | Ohutsuka et al. |
| 5,023,243 | A | 6/1991 | Tullis |
| 5,034,506 | A | 7/1991 | Summerton et al. |
| 5,118,800 | A | 6/1992 | Smith et al. |
| 5,130,302 | A | 7/1992 | Spielvogel et al. |
| 5,132,418 | A | 7/1992 | Caruthers et al. |
| 5,134,066 | A | 7/1992 | Rogers et al. |
| RE34,036 | E | 8/1992 | McGeehan |
| 5,149,797 | A | 9/1992 | Pederson et al. |
| 5,166,315 | A | 11/1992 | Summerton et al. |
| 5,175,273 | A | 12/1992 | Bischofberger et al. |
| 5,177,196 | A | 1/1993 | Meyer, Jr. et al. |
| 5,177,198 | A | 1/1993 | Spielvogel et al. |
| 5,185,444 | A | 2/1993 | Summerton et al. |
| 5,188,897 | A | 2/1993 | Suhadolnik et al. |
| 5,194,599 | A | 3/1993 | Froehler et al. |
| 5,214,134 | A | 5/1993 | Weis et al. |
| 5,216,141 | A | 6/1993 | Benner |
| 5,220,007 | A | 6/1993 | Pederson et al. |
| 5,223,618 | A | 6/1993 | Cook et al. |
| 5,235,033 | A | 8/1993 | Summerton et al. |
| 5,256,775 | A | 10/1993 | Froehler |
| 5,264,423 | A | 11/1993 | Cohen et al. |
| 5,264,562 | A | 11/1993 | Matteucci |
| 5,264,564 | A | 11/1993 | Matteucci |
| 5,276,019 | A | 1/1994 | Cohen et al. |
| 5,286,717 | A | 2/1994 | Cohen et al. |
| 5,319,080 | A | 6/1994 | Leumann |
| 5,321,131 | A | 6/1994 | Agrawal et al. |

(Continued)

FOREIGN PATENT DOCUMENTS

| | | |
|---|---|---|
| WO | WO 2004/045543 | 6/2004 |
| WO | WO 2005/116204 | 12/2005 |

(Continued)

OTHER PUBLICATIONS

Fearon et al., Phosphorothioate Oligodeoxynucleotides: Large-Scale Synthesis and Analysis, Impurity Characterization, and the Effects of Phosphorus Stereochemistry. In Ciba Foundation Symposium 209—Oligonucleotides as Therapeutic Agents, doi.org/10.1002/9780470515396.ch3 (Year: 2007).*
www.collinsdictionary.com/us/dictionary/english/according-to, accessed to Feb. 13, 2025 (Year: 2025).*
www.merriam-webster.com/dictionary/according%20to, accessed on Feb. 13, 2025 (Year: 2025).*
Barrie et al., "Modulation of Rumpshaker Phenotype with Wild-Type PLP/DM20 Suggests Several Pathogenic Mechanisms" J Neurosci Res (2010) 88: 2135-2145.
Bijland et al., "An in vitro model for studying CNS white matter: functional properties and experimental approaches" F1000Research (2019) 8: 1-27.

(Continued)

*Primary Examiner* — Jennifer Dunston
*Assistant Examiner* — Keyur A Vyas
(74) *Attorney, Agent, or Firm* — McNeill PLLC

(57) ABSTRACT

Provided are compounds, methods, and pharmaceutical compositions for reducing the amount or activity of PLP1 RNA in a cell or subject, and in certain instances reducing the amount of proteolipid protein 1 in a cell or subject. Such compounds, methods, and pharmaceutical compositions are useful to ameliorate at least one symptom or hallmark of a leukodystrophy. Such symptoms and hallmarks include hypotonia, nystagmus, optic atrophy, respiratory distress, motor delays, cognitive dysfunction, speech dysfunction, spasticity, ataxia, seizures, choreiform movements, and death. Such leukodystrophies include Pelizaeus-Merzbacher disease.

32 Claims, No Drawings

Specification includes a Sequence Listing.

(56) References Cited

U.S. PATENT DOCUMENTS 5,359,044 A 10/1994 Cook et al.
5,366,878 A 11/1994 Pederson et al.
5,367,066 A 11/1994 Urdea et al.
5,378,825 A 1/1995 Cook et al.
5,386,023 A 1/1995 Sanghvi et al.
5,393,878 A 2/1995 Leumann
5,399,676 A 3/1995 Froehler
5,403,711 A 4/1995 Walder et al.
5,405,938 A 4/1995 Sumerton et al.
5,405,939 A 4/1995 Suhadolnik et al.
5,432,272 A 7/1995 Benner
5,434,257 A 7/1995 Matteucci
5,446,137 A 8/1995 Maag et al.
5,453,496 A 9/1995 Caruthers et al.
5,455,233 A 10/1995 Spielvogel et al.
5,457,187 A 10/1995 Gmelner et al.
5,457,191 A 10/1995 Cook et al.
5,459,255 A 10/1995 Cook et al.
5,466,677 A 11/1995 Baxter et al.
5,466,786 A 11/1995 Burh et al.
5,470,967 A 11/1995 Huie et al.
5,476,925 A 12/1995 Letsinger et al.
5,484,908 A 1/1996 Froehler et al.
5,489,677 A 2/1996 Sanghvi et al.
5,491,133 A 2/1996 Walder et al.
5,502,177 A 3/1996 Matteucci et al.
5,508,270 A 4/1996 Baxter et al.
5,514,785 A 5/1996 Van Ness et al.
5,519,126 A 5/1996 Hecht
5,519,134 A 5/1996 Acevedo et al.
5,525,711 A 6/1996 Hawkins et al.
5,527,899 A 6/1996 Froehler
5,536,821 A 7/1996 Agrawal et al.
5,541,306 A 7/1996 Agrawal et al.
5,541,307 A 7/1996 Cook et al.
5,550,111 A 8/1996 Suhadolnik et al.
5,552,540 A 9/1996 Haralambidis
5,561,225 A 10/1996 Maddry et al.
5,563,253 A 10/1996 Agrawal et al.
5,565,350 A 10/1996 Kmiec
5,565,555 A 10/1996 Froehler et al.
5,567,811 A 10/1996 Mistura et al.
5,571,799 A 11/1996 Tkachuk et al.
5,576,427 A 11/1996 Cook et al.
5,587,361 A 12/1996 Cook et al.
5,587,469 A 12/1996 Cook et al.
5,587,470 A 12/1996 Cook et al.
5,591,722 A 1/1997 Montgomery et al.
5,594,121 A 1/1997 Froehler et al.
5,596,086 A 1/1997 Matteucci
5,596,091 A 1/1997 Switzer
5,597,909 A 1/1997 Urdea et al.
5,602,240 A 2/1997 De Mesmaeker et al.
5,608,046 A 3/1997 Cook et al.
5,610,289 A 3/1997 Cook et al.
5,610,300 A 3/1997 Altmann et al.
5,614,617 A 3/1997 Cook et al.
5,618,704 A 4/1997 Sanghvi et al.
5,623,065 A 4/1997 Cook et al.
5,623,070 A 4/1997 Cook et al.
5,625,050 A 4/1997 Beaton et al.
5,627,053 A 5/1997 Usman et al.
5,633,360 A 5/1997 Bishofberger et al.
5,639,873 A 6/1997 Barascut et al.
5,645,985 A 7/1997 Froehler et al.
5,646,265 A 7/1997 McGee
5,646,269 A 7/1997 Matteucci
5,652,355 A 7/1997 Metelev et al.
5,652,356 A 7/1997 Agrawal
5,663,312 A 9/1997 Chaturvedula
5,670,633 A 9/1997 Cook et al.
5,672,697 A 9/1997 Buhr et al.
5,677,437 A 10/1997 Teng et al.
5,677,439 A 10/1997 Weis et al.
5,681,941 A 10/1997 Cook et al.
5,698,685 A 12/1997 Summerton et al.
5,700,920 A 12/1997 Altmann et al.
5,700,922 A 12/1997 Cook
5,721,218 A 2/1998 Froehler
5,750,692 A 5/1998 Cook et al.
5,763,588 A 6/1998 Matteucci et al.
5,792,608 A 8/1998 Swaminathan et al.
5,792,847 A 8/1998 Burh et al.
5,801,154 A 9/1998 Baracchini et al.
5,808,027 A 9/1998 Cook et al.
5,830,653 A 11/1998 Froehler et al.
5,859,221 A 1/1999 Cook et al.
5,948,903 A 9/1999 Cook et al.
5,994,517 A 11/1999 Ts'O
6,005,087 A 12/1999 Cook et al.
6,005,096 A 12/1999 Matteucci et al.
6,166,199 A 12/2000 Cook et al.
6,300,319 B1 10/2001 Manoharan
6,372,492 B1 * 4/2002 Bennett ................ C12N 15/113
435/375
6,426,220 B1 7/2002 Bennett et al.
6,525,191 B1 2/2003 Ramasamy
6,531,584 B1 3/2003 Cook et al.
6,582,908 B2 6/2003 Fodor et al.
6,600,032 B1 7/2003 Manoharan et al.
6,660,720 B2 12/2003 Manoharan
6,770,748 B2 8/2004 Imanishi et al.
7,015,315 B1 3/2006 Cook et al.
7,053,207 B2 5/2006 Wengel et al.
7,101,993 B1 9/2006 Cook et al.
7,262,177 B2 8/2007 Ts'o et al.
7,399,845 B2 7/2008 Seth et al.
7,427,672 B2 9/2008 Imanishi et al.
7,491,805 B2 2/2009 Vargeese et al.
7,547,684 B2 6/2009 Seth et al.
7,569,686 B1 8/2009 Bhat et al.
7,655,785 B1 2/2010 Bentwich
7,666,854 B2 2/2010 Seth et al.
7,696,345 B2 4/2010 Allerson et al.
7,723,509 B2 5/2010 Manoharan et al.
7,741,457 B2 6/2010 Swayze et al.
7,750,131 B2 7/2010 Seth et al.
7,875,733 B2 1/2011 Bhat et al.
7,884,260 B2 2/2011 Popko et al.
7,888,497 B2 2/2011 Bentwich et al.
7,939,677 B2 5/2011 Bhat et al.
8,022,193 B2 9/2011 Swayze et al.
8,030,467 B2 10/2011 Seth et al.
8,080,644 B2 12/2011 Wengel et al.
8,088,746 B2 1/2012 Seth et al.
8,088,904 B2 1/2012 Swayze et al.
8,106,022 B2 1/2012 Manoharan et al.
8,124,745 B2 2/2012 Allerson et al.
8,153,365 B2 4/2012 Wengel et al.
8,178,503 B2 5/2012 Rigoutsos et al.
8,268,980 B2 9/2012 Seth et al.
8,278,283 B2 10/2012 Seth et al.
8,278,425 B2 10/2012 Prakash et al.
8,278,426 B2 10/2012 Seth et al.
8,415,106 B2 4/2013 Popko et al.
8,440,803 B2 5/2013 Swayze et al.
8,501,805 B2 8/2013 Seth et al.
8,530,640 B2 9/2013 Seth et al.
8,546,556 B2 10/2013 Seth et al.
RE44,779 E 2/2014 Imanishi et al.
8,828,956 B2 9/2014 Manoharan et al.
9,005,906 B2 4/2015 Swayze et al.
9,012,421 B2 4/2015 Migawa et al.
9,127,276 B2 9/2015 Prakash et al.
9,290,760 B2 3/2016 Rajeev et al.
11,732,263 B2 8/2023 Powers
2001/0053519 A1 12/2001 Fodor et al.
2003/0158403 A1 8/2003 Manoharan et al.
2003/0175906 A1 9/2003 Manoharan et al.
2003/0228597 A1 12/2003 Cowsert et al.
2004/0171570 A1 9/2004 Allerson et al.
2005/0130923 A1 6/2005 Bhat et al.
2006/0148740 A1 7/2006 Platenburg
2007/0031844 A1 2/2007 Khvorova et al.

(56) References Cited

U.S. PATENT DOCUMENTS

2007/0134655 A1 6/2007 Bentwich et al.
2008/0039618 A1 2/2008 Allerson et al.
2009/0018031 A1 1/2009 Trinklein et al.
2010/0130595 A1* 5/2010 Dean ........................ A61P 19/04
435/325
2010/0190837 A1 7/2010 Migawa et al.
2010/0197762 A1 8/2010 Swayze et al.
2011/0178283 A1 7/2011 Rigoutsos et al.
2013/0130378 A1 5/2013 Manoharan et al.
2014/0107330 A1 4/2014 Freier et al.
2015/0018540 A1 1/2015 Prakash et al.
2015/0184153 A1 7/2015 Freier et al.
2015/0191727 A1 7/2015 Migawa et al.
2015/0267195 A1 9/2015 Seth et al.
2015/0275212 A1 10/2015 Albaek et al.
2019/0390197 A1 12/2019 Butler et al.
2020/0040345 A1 2/2020 Tesar et al.
2020/0370046 A1* 11/2020 Dindot ................... C07H 21/04
2022/0056445 A1 2/2022 Powers

FOREIGN PATENT DOCUMENTS

WO WO 2006/006948 1/2006
WO WO 2008/020435 2/2008
WO WO 2013/173637 11/2013
WO WO 2016/203262 12/2016
WO WO 2018/106782 6/2018
WO WO 2019/156115 8/2019
WO WO 2022/006134 1/2022
WO WO 2022/031847 2/2022

OTHER PUBLICATIONS

Branch et al., "A good antisense molecule is hard to find," TIBS (1998) 23:45-50.
Chin "On the Preparation and Utilization of Isolated and Purified Oligonucleotides" Document purportedly located on a CD-ROM and contributed to the public collection of the Katherine R. Everett Law Library of the University of North Carolina on Mar. 14, 2002.
Crooke et al., "Basic Principles of Antisense Therapeutics" Antisense Research and Application (1998) Chapter 1:1-50.
Crooke, ST., et al., "Antisense Drug Technology" Second Edition, CRC Press (2008) Chapters 1-28.
Egli, et al., "Synthesis, improved antisense activity and structural rationale for the divergent RNA affinities of 3'-fluoro hexitol nucleic acid (FHNA and Ara-FHNA) modified oligonucleotides." J Am Chem (2011) 133(41):16642-16649.
Elitt et al., "Therapeutic suppression of proteolipid protein rescues Pelizaeus-Merzbacher Disease in mice" bioRxiv (2018) 1-52.
Elitt et al., "Suppression of proteolipid protein rescues Pelizaeus-Merzbacher Disease" Nature (2020) 585: 397-403.
Elitt et al., "Therapeutic Suppression of proteolipid protein rescues Pelizaeus-Merzbacher Disease in mice" Poster for Keystone: From Rare to Care: Discovery, Modeling and Translation of Rare Diseases Conference (Nov. 11-14, 2018) Vienna, Austria.
Garbern et al., "The molecular pathogenesis of Pelizaeus-Merzbacher disease" Arch Neurol (1999) 56: 1210-1214.
Gautschi et al., "Activity of a novel bcl-2/bcl-xLbispecific antisense oligonucleotide against tumors of diverse histologic origins" J. Natl. Cancer Inst. (2001) 93:463-471.
GenBank Accession NC_000023.11 *Homo sapiens* chromosome X, GRCh38.p13 Primary Assembly (May 29, 2020) [online]. [Retrieved on Oct. 5, 2021]. Retrieved from the Internet: <URL: https://www.ncbi.nlm.nih.gov/nuccore/568815575?sat=48&satkey=93022424>; nucleotides 103776824-103776805, 100% identity to SEQ ID No. 20.
GenBank Accession M95057.1 Human proteolipid protein (PLP) gene, upstream region and 5' end of exon 1 (1995) [online]. (Retrieved on Oct. 4, 2021]. Retrieved from the Internet: <URL: https://www.ncbi.nlm.nih.gov/nuccore/M95057.1/ >];in entirety; nucleotides 303-284, 100% complementary to SEQ ID No. 20.
Hobson et al., "Pelizaeus-Merzbacher Disease, Pelizaeus-Merzbacher-Like Disease 1, and Related Hypomyelinating Disorders" Semin Neurol (2012) 32: 62-67.
International Search Report for PCT/US21/039651 dated Dec. 22, 2021.
Karim et al., "PLP/DM20 Expression and Turnover in a Transgenic Mouse Model of Pelizaeus-Merzbacher Disease" GLIA (2010) 58: 1727-1738.
Khalaf et al. "Mutation of Proteolipid Protein 1 Gene: From Severe Hypomyelinating Leukodystrophy to Inherited Spastic Paraplegia" Biomedicines (2022) 10: 1-20.
Lane et al., "Antisense Oligonucleotide (ASO) Approach to the Treatment of Pelizaeus-Merzbacher Disease (PMD)" Presentation for Global Leukodystrophy Initiative Conference (GLIA) (May 1-3, 2019).
Li et al., "Gene suppressing therapy for Pelizaeus-Merzbacher disease using artificial microRNA" JCI Insight (2019) 4: 1-20.
Lucchinetti et al., "A role for humoral mechanisms in the pathogenesis of Devic's neuromyelitis optica" Brain (2002) 125: 1450-1461.
Madhavan "Modeling and Therapy for Pelizaeus-Merzbacher Disease" Presentation for American Society of Neurochemistry Annual Meeting (virtual) Jun. 27-Jul. 1, 2021.
Maher et al., "Comparative hybrid arrest by tandem antisense oligodeoxyribonucleotides or oligodeoxyribonucleoside methylpbosphonates in a cell-free system" Nucl. Acid. Res. (1988) 16(8):3341-3358.
New England Biolabs 1998/99 Catalog (cover page and pp. 121 and 284).
Osorio et al., "Concise Review: Stem Cell-Based Treatment of Pelizaeus-Merzbacher Disease" Stem Cells (2017) 35: 311-315.
Powers et al., "Antisense oligonucleotides (ASOs) effeciently target glial cells and provide a novel therapeutic platform for demyelinating disorders" Presentation for Society of Neuroscience (Nov. 7, 2018).
Powers et al., "Antisense oligonucleotides (ASOs) efficiently target glial cells and provide a novel therapeutic platform for demyelinating disorders" Society for Neuroscience 48th Annual Meeting (Nov. 3-7, 018) San Diego, CA.
Rangachari et al., "Using EAE to better understand principles of immune function and autoimmune pathology" J Autoimmunity (2013) 45: 31-39.
Regis et al., "Restoration of the normal splicing pattern of the PLP1 gene by means of an antisense oligonucleotide directed against an exonic mutation" PLoS One (2013) 8: e73633.
Reynolds et al., "Rational siRNA design for RNA interference" Nature Biotechnology (2004) 22(3):326-330.
Sanghvi et al., "Heterocyclic Base Modifications in Nucleic Acids and Their Applications in Antisense Oligonucleotides" Antisense Research and Applications (1993) pp. 273-288.
Seth et al., "Short Antisense Oligonucleotides with Novel 2'-4' Conformationaly Restricted Nucleoside Analogues Show Improved Potency Without Increased Toxicity in Animals." J Med Chem (2009) 52:10-13.
Tantzer et al., "Morpholino Antisense Oligomers as a Potential Therapeutic Option for the Correction of Alternative Splicing in PMD, SPG2, and HEMS" Mol Ther Nucleic Acids (2018) 12: 420-432.
Taymans et al., "LRRK2 Kinase Inhibition as a Therapeutic Strategy for Parkinson's Disease, Where Do We Stand" Current Neuropharmacology (2016) 14: 214-225.
Wang et al., "Epileptic Seizures and Electroencephalographic Evolution in Genetic Leukodystrophies" J Clin Neurophysiology (2001) 18: 25-32.
Wolf et al., "PLP1 Disorders" Gene Reviews (1999) 1-22.
Woolf et al., "Specificity of antisense oligonucleotides in vivo" PNAS (1992) 89: 7305-7309.
Yang et al., "Proteolipid Protein Regulates the Survival nad Differentiation of Oligodendrocytes" J Nerosc (1997) 17(6): 2056-2070.
International Search Report for PCT/US23/064867 dated Sep. 5, 2023.

(56) References Cited

OTHER PUBLICATIONS

Extended European Search Report issued in EP Application No. 21833921.6, 9 pages, dated May 12, 2025.
Pereira et al., "Expression of Myelin Genes: A Comparative Analysis of Oli-neu and N20.1 Oligodendroglial Cell Lines," J Neurosci Res. 2011, 89(7): pp. 1070-1078.

* cited by examiner

COMPOUNDS AND METHODS FOR MODULATING PLP1

SEQUENCE LISTING

The present application is being filed along with a Sequence Listing in electronic format. The Sequence Listing is provided as a file entitled BIOL0382SEQ.xml, created on May 23, 2023, which is 2,012 Kb in size. The information in the electronic format of the sequence listing is incorporated herein by reference in its entirety.

FIELD

Provided are compounds, methods, and pharmaceutical compositions for reducing the amount or activity of proteolipid protein 1 (PLP1) RNA in a cell or subject, and in certain instances reducing the amount of proteolipid protein 1 in a cell or subject. Such compounds, methods, and pharmaceutical compositions are useful to ameliorate at least one symptom or hallmark of a leukodystrophy. Such symptoms and hallmarks include hypotonia, nystagmus, optic atrophy, respiratory distress, motor delays, cognitive dysfunction, speech dysfunction, spasticity, ataxia, seizures, choreiform movements, and death. Such leukodystrophies include Pelizaeus-Merzbacher disease.

BACKGROUND

Pelizaeus-Merzbacher disease (PMD) is a severe and fatal childhood X-linked leukodystrophy, associated with an extensive loss or lack of myelination of the central nervous system, and is caused by duplications or sequence variations in the gene encoding proteolipid protein 1 (PLP1). Hundreds of mutations in PLP1 have been identified, and lead to a toxic gain-of-function due to PLP1 misfolding and dysmyelination (Hobson, G., 2012, Semin. Neurol. 32, 62-67; Nevin, Z. S., 2017, American J. Hum. Genetics 100, 617-634; Sima, A. A. F., et al., 2009, Acta Neuropathologica 118, 431-439). The majority of PMD cases are due to overexpression of otherwise normal PLP1 protein, as a result of duplications or triplications of PLP1 (Inoue, K., 2005, Neurogenetics 6, 1-16; Karim, S. A., 2010, Glia 58, 1727-1738). PLP1 is expressed in myelinating oligodendrocytes and oligodendrocyte progenitor cells (OPCs) in the central nervous system (CNS), where it is responsible for about 50% of the total protein content of myelin and in Schwann cells in the peripheral nervous system (PNS) (Klugman, W., et al., 1997, Neuron 18, 59-70; Harlow, D. E., et al., 2014, J. Neurosci. 34, 1333-1343; Baumann, N., et al., 2001, Physiol. Rev. 81, 871-927).

Because of the genetic heterogeneity associated with PMD, symptoms and hallmarks vary and have been grouped into two main categories: connatal and classic. The connatal form (severe/early onset) of PMD is caused by mutations in PLP1, leading to dysmyelination. This most severe form of PMD leads to mortality in early childhood, typically within the first few years of life, and presents symptoms such as nystagmus and respiratory distress, extrapyramidal signs, laryngeal stridor, feeding difficulties, optic atrophy, seizures, and extreme neonatal hypotonia. The classic form, associated with PLP1 overexpression due to PLP1 duplication or triplication, presents before the first year of age with a constellation of motor delays, hypotonia, nystagmus, and/or motor delay in early childhood, with the development of progressive spasticity, ataxia, and/or choreiform movements through adolescence and early adulthood. Other PMD phenotypes include the transitional form of PMD, associated with PLP1 overexpression or with PLP1 mutations, which combines clinical features of both the classic and connatal forms. A less severe phenotype, Spastic paraplegia type 2 (SPG2), has a later onset than classic PMD, and is associated with a mild, late-onset spasticity in the legs or assorted mild peripheral neuropathies with minimal CNS deficits. Patients with PLP1 deletions ("null" patients) have significantly milder symptoms than patients with PLP1 mutations or duplications, and can live until 40-60 years old. There are no approved therapies for PMD, with current therapy mainly being limited to palliative symptom management (Nevin, 2017; Inoue, 2005; Madry, J., et al., 2010, Neurol. Neurochir. Pol. 44, 511-515; Osorio, M. J., et al., 2017, Stem Cells 35, 311-315; Wang, P-J, et al., 2001, J. Clin. Neurophys. 18, 25-32).

Currently there is a lack of acceptable options for treating leukodystrophies such as PMD. It is therefore an object herein to provide compounds, methods, and pharmaceutical compositions for the treatment of such diseases.

SUMMARY OF THE INVENTION

Provided herein are compounds, methods and pharmaceutical compositions for reducing the amount or activity of PLP1 RNA, and in certain embodiments reducing the expression of proteolipid protein 1 in a cell or animal. In certain embodiments, the subject has a disease or disorder associated with overexpression of PLP1 or a mutation in PLP1. In certain embodiments, the subject has a leukodystrophy. In certain embodiments, the subject has Pelizaeus-Merzbacher disease. In certain embodiments, compounds useful for reducing the amount or activity of PLP1 RNA are oligomeric compounds. In certain embodiments, compounds useful for reducing the amount or activity of PLP1 RNA are modified oligonucleotides. In certain embodiments, compounds useful for decreasing expression of proteolipid protein 1 are oligomeric compounds. In certain embodiments, compounds useful for decreasing expression of proteolipid protein 1 are modified oligonucleotides.

Also provided are methods useful for ameliorating at least one symptom or hallmark of a leukodystrophy. In certain embodiments, the leukodystrophy is Pelizaeus-Merzbacher disease. In certain embodiments, the symptom or hallmark includes hypotonia, nystagmus, optic atrophy, respiratory distress, motor delays, cognitive dysfunction, speech dysfunction, spasticity, ataxia, seizures, or choreiform movements.

DETAILED DESCRIPTION OF THE INVENTION

It is to be understood that both the foregoing general description and the following detailed description are exemplary and explanatory only and are not restrictive. Herein, the use of the singular includes the plural unless specifically stated otherwise. As used herein, the use of "or" means "and/or" unless stated otherwise. Furthermore, the use of the term "including" as well as other forms, such as "includes" and "included" is not limiting. Also, terms such as "element" or "component" encompass both elements and components comprising one unit and elements and components that comprise more than one subunit, unless specifically stated otherwise.

The section headings used herein are for organizational purposes only and are not to be construed as limiting the subject matter described. All documents, or portions of documents, cited in this application, including, but not limited to, patents, patent applications, articles, books, treatises, and GenBank, ENSEMBL, and NCBI reference sequence records, are hereby expressly incorporated-by-reference for the portions of the document discussed herein, as well as in their entirety.

Definitions

Unless specific definitions are provided, the nomenclature used in connection with, and the procedures and techniques of, analytical chemistry, synthetic organic chemistry, and medicinal and pharmaceutical chemistry described herein are those well-known and commonly used in the art. Where permitted, all patents, applications, published applications and other publications and other data referred to throughout in the disclosure are incorporated by reference herein in their entirety.

Unless otherwise indicated, the following terms have the following meanings:

Definitions

As used herein, "2'-deoxynucleoside" means a nucleoside comprising a 2'-H(H) deoxyfuranosyl sugar moiety. In certain embodiments, a 2'-deoxynucleoside is a 2'-β-D-deoxynucleoside and comprises a 2'-β-D-deoxyribosyl sugar moiety, which has the β-D ribosyl configuration as found in naturally occurring deoxyribonucleic acids (DNA). In certain embodiments, a 2'-deoxynucleoside may comprise a modified nucleobase or may comprise an RNA nucleobase (uracil).

As used herein, "2'-MOE" means a 2'-$OCH_2CH_2OCH_3$ group in place of the 2'-OH group of a furanosyl sugar moiety. A "2'-MOE sugar moiety" means a sugar moiety with a 2'-$OCH_2CH_2OCH_3$ group in place of the 2'-OH group of a furanosyl sugar moiety. Unless otherwise indicated, a 2'-MOE sugar moiety is in the β-D-ribosyl configuration. "MOE" means O-methoxyethyl.

As used herein, "2'-MOE nucleoside" means a nucleoside comprising a 2'-MOE sugar moiety.

As used herein, "2'-OMe" means a 2'-$OCH_3$ group in place of the 2'-OH group of a furanosyl sugar moiety.

A "2'-O-methyl sugar moiety" or "2'-OMe sugar moiety" means a sugar moiety with a 2'-$OCH_3$ group in place of the 2'-OH group of a furanosyl sugar moiety. Unless otherwise indicated, a 2'-OMe sugar moiety is in the β-D-ribosyl configuration.

As used herein, "2'-OMe nucleoside" means a nucleoside comprising a 2'-OMe sugar moiety.

As used herein, "2'-substituted nucleoside" means a nucleoside comprising a 2'-substituted sugar moiety. As used herein, "2'-substituted" in reference to a sugar moiety means a sugar moiety comprising at least one 2'-substituent group other than H or OH.

As used herein, "5-methyl cytosine" means a cytosine modified with a methyl group attached to the 5 position. A 5-methyl cytosine is a modified nucleobase.

As used herein, "administering" means providing a pharmaceutical agent to a subject.

As used herein, "antisense activity" means any detectable and/or measurable change attributable to the hybridization of an antisense compound to its target nucleic acid. In certain embodiments, antisense activity is a decrease in the amount or expression of a target nucleic acid or protein encoded by such target nucleic acid compared to target nucleic acid levels or target protein levels in the absence of the antisense compound.

As used herein, "antisense compound" means an oligomeric compound capable of achieving at least one antisense activity.

As used herein, "ameliorate" in reference to a treatment means improvement in at least one symptom or hallmark relative to the same symptom or hallmark in the absence of the treatment. In certain embodiments, amelioration is the reduction in the severity or frequency of a symptom or hallmark or the delayed onset or slowing of progression in the severity or frequency of a symptom or hallmark. In certain embodiments, the symptom or hallmark is one or more of hypotonia, nystagmus, optic atrophy, respiratory distress, motor delays, cognitive dysfunction, speech dysfunction, spasticity, ataxia, seizures, choreiform movements, and death.

As used herein, "bicyclic nucleoside" or "BNA" means a nucleoside comprising a bicyclic sugar moiety.

As used herein, "bicyclic sugar" or "bicyclic sugar moiety" means a modified sugar moiety comprising two rings, wherein the second ring is formed via a bridge connecting two of the atoms in the first ring thereby forming a bicyclic structure. In certain embodiments, the first ring of the bicyclic sugar moiety is a furanosyl moiety. In certain embodiments, the furanosyl sugar moiety is a ribosyl moiety. In certain embodiments, the bicyclic sugar moiety does not comprise a furanosyl moiety.

As used herein, "cerebrospinal fluid" or "CSF" means the fluid filling the space around the brain and spinal cord. "Artificial cerebrospinal fluid" or "aCSF" means a prepared or manufactured fluid that has certain properties of cerebrospinal fluid.

As used herein, "cleavable moiety" means a bond or group of atoms that is cleaved under physiological conditions, for example, inside a cell, an animal, or a human.

As used herein, "complementary" in reference to an oligonucleotide means that at least 70% of the nucleobases of the oligonucleotide or one or more portions thereof and the nucleobases of another nucleic acid or one or more portions thereof are capable of hydrogen bonding with one another when the nucleobase sequence of the oligonucleotide and the other nucleic acid are aligned in opposing directions. As used herein, "complementary nucleobases" means nucleobases that are capable of forming hydrogen bonds with one another. Complementary nucleobase pairs include adenine (A) and thymine (T), adenine (A) and uracil (U), cytosine (C) and guanine (G), 5-methyl cytosine ($^{m}C$) and guanine (G). Complementary oligonucleotides and/or target nucleic acids need not have nucleobase complementarity at each nucleoside. Rather, some mismatches are tolerated. As used herein, "fully complementary" or "100% complementary" in reference to an oligonucleotide, or a portion thereof, means that the oligonucleotide, or portion thereof, is complementary to another oligonucleotide or target nucleic acid at each nucleobase of the shorter of the two oligonucleotides, or at each nucleoside if the oligonucleotides are the same length.

As used herein, "conjugate group" means a group of atoms that is directly or indirectly attached to an oligonucleotide. Conjugate groups include a conjugate moiety and a conjugate linker that attaches the conjugate moiety to the oligonucleotide.

As used herein, "conjugate linker" means a single bond or a group of atoms comprising at least one bond that connects a conjugate moiety to an oligonucleotide.

As used herein, "conjugate moiety" means a group of atoms that is attached to an oligonucleotide via a conjugate linker.

As used herein, "contiguous" in the context of an oligonucleotide refers to nucleosides, nucleobases, sugar moieties, or internucleoside linkages that are immediately adjacent to each other. For example, "contiguous nucleobases" means nucleobases that are immediately adjacent to each other in a sequence.

As used herein, "cEt" means a 4' to 2' bridge in place of the 2'OH-group of a ribosyl sugar moiety, wherein the bridge has the formula of 4'-CH($CH_3$)—O-2', and wherein the methyl group of the bridge is in the S configuration. A "cEt sugar moiety" is a bicyclic sugar moiety with a 4' to 2' bridge in place of the 2'OH-group of a ribosyl sugar moiety, wherein the bridge has the formula of 4'-CH($CH_3$)—O-2', and wherein the methyl group of the bridge is in the S configuration. "cEt" means constrained ethyl.

As used herein, "cEt nucleoside" means a nucleoside comprising a cEt sugar moiety.

As used herein, "chirally enriched population" means a plurality of molecules of identical molecular formula, wherein the number or percentage of molecules within the population that contain a particular stereochemical configuration at a particular chiral center is greater than the number or percentage of molecules expected to contain the same particular stereochemical configuration at the same particular chiral center within the population if the particular chiral center were stereorandom. Chirally enriched populations of molecules having multiple chiral centers within each molecule may contain one or more stereorandom chiral centers. In certain embodiments, the molecules are modified oligonucleotides. In certain embodiments, the molecules are compounds comprising modified oligonucleotides.

As used herein, "chirally controlled" in reference to an internucleoside linkage means chirality at that linkage is enriched for a particular stereochemical configuration.

As used herein, "deoxy region" means a region of 5-12 contiguous nucleotides, wherein at least 70% of the nucleosides are 2'-β-D-deoxynucleosides. In certain embodiments, each nucleoside is selected from a 2'-β-D-deoxynucleoside, a bicyclic nucleoside, and a 2'-substituted nucleoside. In certain embodiments, a deoxy region supports RNase H activity. In certain embodiments, a deoxy region is the gap or internal region of a gapmer.

As used herein, "gapmer" means a modified oligonucleotide comprising an internal region having a plurality of nucleosides that support RNase H cleavage positioned between external regions having one or more nucleosides, wherein the nucleosides comprising the internal region are chemically distinct from the nucleoside or nucleosides comprising the external regions. The internal region may be referred to as the "gap" and the external regions may be referred to as the "wings" or "wing segments." In certain embodiments, the internal region is a deoxy region. The positions of the internal region or gap refer to the order of the nucleosides of the internal region and are counted starting from the 5'-end of the internal region. Unless otherwise indicated, "gapmer" refers to a sugar motif. In certain embodiments, each nucleoside of the gap is a 2'-β-D-deoxynucleoside. In certain embodiments, the gap comprises one 2'-substituted nucleoside at position 1, 2, 3, 4, or 5 of the gap, and the remainder of the nucleosides of the gap are 2'-β-D-deoxynucleosides. As used herein, the term "MOE gapmer" indicates a gapmer having a gap comprising 2'-β-D-deoxynucleosides and wings comprising 2'-MOE nucleosides. As used herein, the term "mixed wing gapmer" indicates a gapmer having wings comprising modified nucleosides comprising at least two different sugar modifications. Unless otherwise indicated, a gapmer may comprise one or more modified internucleoside linkages and/or modified nucleobases and such modifications do not necessarily follow the gapmer pattern of the sugar modifications.

As used herein, "hotspot region" is a range of nucleobases on a target nucleic acid that is amenable to oligomeric compound-mediated reduction of the amount or activity of the target nucleic acid.

As used herein, "hybridization" means the pairing or annealing of complementary oligonucleotides and/or nucleic acids. While not limited to a particular mechanism, the most common mechanism of hybridization involves hydrogen bonding, which may be Watson-Crick, Hoogsteen or reversed Hoogsteen hydrogen bonding, between complementary nucleobases.

As used herein, "internucleoside linkage" means the covalent linkage between contiguous nucleosides in an oligonucleotide. As used herein, "modified internucleoside linkage" means any internucleoside linkage other than a phosphodiester internucleoside linkage. "Phosphorothioate internucleoside linkage or "PS internucleoside linkage" is a modified internucleoside linkage in which one of the non-bridging oxygen atoms of a phosphodiester internucleoside linkage is replaced with a sulfur atom.

As used herein, "leukodystrophy" means a disorder due to abnormalities in the myelin sheath of neurons.

As used herein, "linker-nucleoside" means a nucleoside that links, either directly or indirectly, an oligonucleotide to a conjugate moiety. Linker-nucleosides are located within the conjugate linker of an oligomeric compound. Linker-nucleosides are not considered part of the oligonucleotide portion of an oligomeric compound even if they are contiguous with the oligonucleotide.

As used herein, "non-bicyclic modified sugar moiety" means a modified sugar moiety that comprises a modification, such as a substituent, that does not form a bridge between two atoms of the sugar to form a second ring.

As used herein, "mismatch" or "non-complementary" means a nucleobase of a first oligonucleotide that is not complementary with the corresponding nucleobase of a second oligonucleotide or target nucleic acid when the first and second oligonucleotide are aligned.

As used herein, "motif" means the pattern of unmodified and/or modified sugar moieties, nucleobases, and/or internucleoside linkages, in an oligonucleotide.

As used herein, "nucleobase" means an unmodified nucleobase or a modified nucleobase. As used herein an "unmodified nucleobase" is adenine (A), thymine (T), cytosine (C), uracil (U), or guanine (G). As used herein, a "modified nucleobase" is a group of atoms other than unmodified A, T, C, U, or G capable of pairing with at least one unmodified nucleobase. A "5-methyl cytosine" is a modified nucleobase. A universal base is a modified nucleobase that can pair with any one of the five unmodified nucleobases. As used herein, "nucleobase sequence" means the order of contiguous nucleobases in a nucleic acid or oligonucleotide independent of any sugar or internucleoside linkage modification.

As used herein, "nucleoside" means a compound, or a fragment of a compound, comprising a nucleobase and a sugar moiety. The nucleobase and sugar moiety are each, independently, unmodified or modified. As used herein, "modified nucleoside" means a nucleoside comprising a modified nucleobase and/or a modified sugar moiety. Modified nucleosides include abasic nucleosides, which lack a nucleobase. "Linked nucleosides" are nucleosides that are connected in a contiguous sequence (i.e., no additional nucleosides are presented between those that are linked).

As used herein, "oligomeric compound" means an oligonucleotide and optionally one or more additional features, such as a conjugate group or terminal group. An oligomeric compound may be paired with a second oligomeric compound that is complementary to the first oligomeric compound or may be unpaired. A "singled-stranded oligomeric compound" is an unpaired oligomeric compound. The term "oligomeric duplex" means a duplex formed by two oligomeric compounds having complementary nucleobase sequences. Each oligomeric compound of an oligomeric duplex may be referred to as a "duplexed oligomeric compound."

As used herein, "oligonucleotide" means a strand of linked nucleosides connected via internucleoside linkages, wherein each nucleoside and internucleoside linkage may be modified or unmodified. Unless otherwise indicated, oligonucleotides consist of 8-50 linked nucleosides. As used herein, "modified oligonucleotide" means an oligonucleotide, wherein at least one nucleoside or internucleoside linkage is modified. As used herein, "unmodified oligonucleotide" means an oligonucleotide that does not comprise any nucleoside modifications or internucleoside modifications.

As used herein, "pharmaceutically acceptable carrier or diluent" means any substance suitable for use in administering to a subject. Certain such carriers enable pharmaceutical compositions to be formulated as, for example, tablets, pills, dragees, capsules, liquids, gels, syrups, slurries, suspension and lozenges for the oral ingestion by a subject. In certain embodiments, a pharmaceutically acceptable carrier or diluent is sterile water, sterile saline, sterile buffer solution or sterile artificial cerebrospinal fluid.

As used herein, "pharmaceutically acceptable salts" means physiologically and pharmaceutically acceptable salts of compounds. Pharmaceutically acceptable salts retain the desired biological activity of the parent compound and do not impart undesired toxicological effects thereto.

As used herein, "pharmaceutical composition" means a mixture of substances suitable for administering to a subject. For example, a pharmaceutical composition may comprise an oligomeric compound and a sterile aqueous solution. In certain embodiments, a pharmaceutical composition shows activity in free uptake assay in certain cell lines.

As used herein, "prodrug" means a therapeutic agent in a form outside the body that is converted to a different form within a subject or cells thereof. Typically, conversion of a prodrug within the subject is facilitated by the action of an enzymes (e.g., endogenous or viral enzyme) or chemicals present in cells or tissues and/or by physiologic conditions.

As used herein, "reducing the amount or activity" refers to a reduction or blockade of the transcriptional expression or activity relative to the transcriptional expression or activity in an untreated or control sample and does not necessarily indicate a total elimination of transcriptional expression or activity.

As used herein, "RNA" means an RNA transcript and includes pre-mRNA and mature mRNA unless otherwise specified.

As used herein, "RNAi compound" means an antisense compound that acts, at least in part, through RISC or Ago2 to modulate a target nucleic acid and/or protein encoded by a target nucleic acid. RNAi compounds include, but are not limited to double-stranded siRNA, single-stranded RNA (ssRNA), and microRNA, including microRNA mimics. In certain embodiments, an RNAi compound modulates the amount, activity, and/or splicing of a target nucleic acid. The term RNAi compound excludes antisense compounds that act through RNase H.

As used herein, "self-complementary" in reference to an oligonucleotide means an oligonucleotide that at least partially hybridizes to itself.

As used herein, "standard in vitro assay" means the assay described in Example 1 and reasonable variations thereof.

As used herein, "standard in vivo assay" means the assay described in Example 5 and reasonable variations thereof.

As used herein, "stereorandom chiral center" in the context of a population of molecules of identical molecular formula means a chiral center having a random stereochemical configuration. For example, in a population of molecules comprising a stereorandom chiral center, the number of molecules having the (S) configuration of the stereorandom chiral center may be but is not necessarily the same as the number of molecules having the (R) configuration of the stereorandom chiral center. The stereochemical configuration of a chiral center is considered random when it is the result of a synthetic method that is not designed to control the stereochemical configuration. In certain embodiments, a stereorandom chiral center is a stereorandom phosphorothioate internucleoside linkage.

As used herein, "subject" means a human or non-human animal. The terms "subject" and "individual" are used interchangeably.

As used herein, "sugar moiety" means an unmodified sugar moiety or a modified sugar moiety. As used herein, "unmodified sugar moiety" means a 2'-OH(H) β-D-ribosyl sugar moiety, as found in RNA (an "unmodified RNA sugar moiety"), or a 2'-H(H) β-D-deoxyribosyl sugar moiety, as found in DNA (an "unmodified DNA sugar moiety"). Unmodified sugar moieties have one hydrogen at each of the 1', 3', and 4' positions, an oxygen at the 3' position, and two hydrogens at the 5' position. As used herein, "modified sugar moiety" or "modified sugar" means a modified furanosyl sugar moiety or a sugar surrogate.

As used herein, "sugar surrogate" means a modified sugar moiety having other than a furanosyl moiety that can link a nucleobase to another group, such as an internucleoside linkage, conjugate group, or terminal group in an oligonucleotide. Modified nucleosides comprising sugar surrogates can be incorporated into one or more positions within an oligonucleotide and such oligonucleotides are capable of hybridizing to complementary oligomeric compounds or target nucleic acids.

As used herein, "symptom or hallmark" means any physical feature or test result that indicates the existence or extent of a disease or disorder. In certain embodiments, a symptom is apparent to a subject or to a medical professional examining or testing said subject. In certain embodiments, a hallmark is apparent upon invasive diagnostic testing, including, but not limited to, post-mortem tests. In certain embodiments, a hallmark is apparent on a brain MRI scan.

As used herein, "target nucleic acid" and "target RNA" mean a nucleic acid that an antisense compound is designed to affect. Target RNA means an RNA transcript and includes pre-mRNA and mature mRNA unless otherwise specified.

As used herein, "target region" means a portion of a target nucleic acid to which an oligomeric compound is designed to hybridize.

As used herein, "terminal group" means a chemical group or group of atoms that is covalently linked to a terminus of an oligonucleotide.

As used herein, "therapeutically effective amount" means an amount of a pharmaceutical agent that provides a therapeutic benefit to a subject. For example, a therapeutically effective amount improves a symptom or hallmark of a disease or disorder.

As used herein, "treating" means improving a subject's disease or disorder by administering an oligomeric agent or oligomeric compound described herein. In certain embodiments, treating a subject improves a symptom relative to the same symptom in the absence of the treatment. In certain embodiments, treatment reduces in the severity or frequency of a symptom, or delays the onset of a symptom, slows the progression of a symptom, or slows the severity or frequency of a symptom.

CERTAIN EMBODIMENTS

The present disclosure provides the following non-limiting numbered embodiments:

Embodiment 1. An oligomeric compound comprising a modified oligonucleotide consisting of 12 to 30 linked nucleosides wherein the nucleobase sequence of the modified oligonucleotide is at least 85% complementary to an equal length portion of a PLP1 nucleic acid, and wherein the modified oligonucleotide comprises at least one modification selected from a modified sugar moiety and a modified internucleoside linkage.

Embodiment 2. An oligomeric compound comprising a modified oligonucleotide consisting of 12 to 30 linked nucleosides and having a nucleobase sequence comprising at least 12, at least 13, at least 14, at least 15, at least 16, at least 17, at least 18, at least 19, or 20 contiguous nucleobases of any of the nucleobase sequences of SEQ ID NOs: 20-2155, wherein the modified oligonucleotide comprises at least one modification selected from a modified sugar moiety and a modified internucleoside linkage.

Embodiment 3. An oligomeric compound comprising a modified oligonucleotide consisting of 12 to 30 linked nucleosides and having a nucleobase sequence comprising at least 8, at least 9, at least 10, at least 11, at least 12, at least 13, at least 14, at least 15, at least 16, at least 17, at least 18, at least 19, or at least 20 contiguous nucleobases complementary to:

- an equal length portion of nucleobases 9198-9222 of SEQ ID NO: 2;
- an equal length portion of nucleobases 13702-13766 of SEQ ID NO: 2;
- an equal length portion of nucleobases 14037-14062 of SEQ ID NO: 2;
- an equal length portion of nucleobases 16761-16800 of SEQ ID NO: 2;
- an equal length portion of nucleobases 17558-17602 of SEQ ID NO: 2;
- an equal length portion of nucleobases 17615-17667 of SEQ ID NO: 2;
- an equal length portion of nucleobases 17853-17883 of SEQ ID NO: 2;
- an equal length portion of nucleobases 18097-18160 of SEQ ID NO: 2;
- an equal length portion of nucleobases 18206-18237 of SEQ ID NO: 2;
- an equal length portion of nucleobases 18237-18340 of SEQ ID NO: 2;
- an equal length portion of nucleobases 18350-18387 of SEQ ID NO: 2;
- an equal length portion of nucleobases 18412-18469 of SEQ ID NO: 2;
- an equal length portion of nucleobases 18461-18506 of SEQ ID NO: 2;
- an equal length portion of nucleobases 18539-18579 of SEQ ID NO: 2;
- an equal length portion of nucleobases 18697-18727 of SEQ ID NO: 2;
- an equal length portion of nucleobases 18755-18793 of SEQ ID NO: 2;
- an equal length portion of nucleobases 18797-18819 of SEQ ID NO: 2;
- an equal length portion of nucleobases 18839-18862 of SEQ ID NO: 2;
- an equal length portion of nucleobases 18974-19021 of SEQ ID NO: 2;
- an equal length portion of nucleobases 19028-19080 of SEQ ID NO: 2;
- an equal length portion of nucleobases 19146-19173 of SEQ ID NO: 2;
- an equal length portion of nucleobases 19228-19253 of SEQ ID NO: 2;
- an equal length portion of nucleobases 19347-19393 of SEQ ID NO: 2;
- an equal length portion of nucleobases 19500-19523 of SEQ ID NO: 2; or
- an equal length portion of nucleobases 19512-19534 of SEQ ID NO: 2, wherein the modified oligonucleotide comprises at least one modification selected from a modified sugar moiety and a modified internucleoside linkage.

Embodiment 4. An oligomeric compound comprising a modified oligonucleotide consisting of 12 to 30 linked nucleosides and having a nucleobase sequence comprising at least 8, at least 9, at least 10, at least 11, at least 12, at least 13, at least 14, at least 15, at least 16, at least 17, or at least 18 contiguous nucleobases of a sequence selected from:

- SEQ ID NOs: 1050, 1124, 2145, 2151, 2152, 2153;
- SEQ ID NOs: 36, 86, 114, 164, 191, 242, 269, 426, 523, 602, 691, 780;
- SEQ ID NOs: 89, 167, 245, 322, 323;
- SEQ ID NOs: 720, 808, 904, 937, 1058, 1097, 1184, 1278, 1340;
- SEQ ID NOs: 40, 41, 117, 118, 195, 196, 273, 274, 588, 690;
- SEQ ID NOs: 42, 43, 119, 120, 197, 198, 275, 276, 373, 460, 1431, 1542, 1645, 1850, 1965, 2109;
- SEQ ID NOs: 1451, 1499, 1543, 1654, 1733, 2154, 2155,
- SEQ ID NOs: 200, 420, 504, 620, 646, 709, 823, 980, 1029, 1149, 1196, 1253, 1323, 1423, 1476, 1605, 1613, 1728, 1832;
- SEQ ID NOs: 45, 46, 123, 124, 201, 202, 279, 280, 538, 562, 2091;
- SEQ ID NOs: 48, 49, 50, 51, 52, 53, 125, 126, 127, 128, 129, 130, 131, 203, 204, 205, 206, 207, 208, 281, 282, 283, 284, 285, 286, 414, 459, 485, 503, 579, 580, 693, 724, 840, 873, 911, 1034, 1081, 1125, 1159, 1318, 1413, 1513, 1548, 1672, 1701, 1794, 1868, 1958, 2002;
- SEQ ID NOs: 209, 287, 335, 439, 506, 606, 659, 1922, 2033, 2104;
- SEQ ID NOs: 784, 842, 869, 978, 1082, 1131, 1218, 1250, 1320, 1453, 1529, 1538, 1616, 1712, 1821;
- SEQ ID NOs: 54, 55, 132, 133, 210, 288, 419, 499, 564, 665, 764, 800, 881, 993, 1059, 1200, 1295, 1354, 1422, 1465, 1544, 1705, 1802, 2149;
- SEQ ID NOs: 338, 438, 525, 604, 658, 758, 813, 887, 977, 1043, 1108, 1199, 1258, 1336, 1395, 1514, 1557, 1668, 1697, 2089;
- SEQ ID NOs: 875, 934, 1047, 1110, 1229, 1243, 1373, 1438, 2146, 2147;

SEQ ID NOs: 761, 798, 890, 946, 1022, 1120, 1198, 1293, 1358, 1398, 1463;

SEQ ID NOs: 56, 134, 683, 718;

SEQ ID NOs: 1610, 1663, 1702, 1786;

SEQ ID NOs: 212, 1060, 1090, 1181, 1277, 1446, 1510, 1589, 1646, 1693, 1772, 2148;

SEQ ID NOs: 57, 586, 666, 714, 812, 914, 951, 1052, 1138, 1162, 1248, 1363, 1455;

SEQ ID NOs: 385, 416, 545, 621, 682, 1968, 2055, 2101, 2150;

SEQ ID NOs: 363, 467, 541, 2008, 2111;

SEQ ID NOs: 58, 59, 136, 213, 214, 291, 292, 383, 417, 519, 612, 671, 730, 900, 986, 1019, 1136, 1353, 1457, 1504, 1546, 2093;

SEQ ID NOs: 398, 435, 2095, 2010, 2144; or

SEQ ID NOs: 1201, 1238, 1341, 1435, wherein the modified oligonucleotide comprises at least one modification selected from a modified sugar moiety and a modified internucleoside linkage.

Embodiment 5. The oligomeric compound of any of embodiments 1-4, wherein the modified oligonucleotide has a nucleobase sequence that is at least 80%, at least 85%, at least 90%, at least 95%, or 100% complementary to the nucleobase sequence of SEQ ID NO: 1 or SEQ ID NO: 2 when measured across the entire nucleobase sequence of the modified oligonucleotide.

Embodiment 6. The oligomeric compound of any of embodiments 1-5, wherein the modified oligonucleotide comprises at least one modified nucleoside comprising a modified sugar moiety.

Embodiment 7. The oligomeric compound of embodiment 6, wherein the modified oligonucleotide comprises at least one modified nucleoside comprising a bicyclic sugar moiety.

Embodiment 8. The oligomeric compound of embodiment 7, wherein the bicyclic sugar moiety comprises a 4'-2' bridge, wherein the 4'-2' bridge is selected from —$CH_2$—O—; and —$CH(CH_3)$—O—.

Embodiment 9. The oligomeric compound of any of embodiments 6-8, wherein the modified oligonucleotide comprises at least one modified nucleoside comprising a non-bicyclic modified sugar moiety.

Embodiment 10. The oligomeric compound of embodiment 9, wherein the non-bicyclic modified sugar moiety is a 2'-MOE sugar moiety or a 2'-OMe sugar moiety.

Embodiment 11. The oligomeric compound of any of embodiments 6-10, wherein the modified oligonucleotide comprises at least one modified nucleoside comprising a sugar surrogate.

Embodiment 12. The oligomeric compound of embodiment 11, wherein the sugar surrogate is any of morpholino, modified morpholino, PNA, THP, and F-HNA.

Embodiment 13. The oligomeric compound of any of embodiments 1-6 or 9-12, wherein the modified oligonucleotide does not comprise a bicyclic sugar moiety.

Embodiment 14. The oligomeric compound of any of embodiments 1-13, wherein the modified oligonucleotide is a gapmer.

Embodiment 15. The oligomeric compound of any of embodiments 1-14, wherein the modified oligonucleotide comprises:

a 5'-region consisting of 1-7 linked 5'-region nucleosides;

a central region consisting of 6-10 linked central region nucleosides; and a 3'-region consisting of 1-7 linked 3'-region nucleosides; wherein each of the 5'-region nucleosides and each of the 3'-region nucleosides comprises a modified sugar moiety and each of the central region nucleosides comprises a 2'-deoxyfuranosyl sugar moiety.

Embodiment 16. The oligomeric compound of embodiment 15, wherein the modified oligonucleotide comprises:

a 5'-region consisting of 5 linked 5'-region nucleosides;

a central region consisting of 10 linked central region nucleosides; and a 3'-region consisting of 5 linked 3'-region nucleosides; wherein each of the 5'-region nucleosides and each of the 3'-region nucleosides is a 2'-MOE nucleoside, and each of the central region nucleosides is a 2'-β-D-deoxynucleoside.

Embodiment 17. The oligomeric compound of embodiment 15, wherein the modified oligonucleotide comprises:

a 5'-region consisting of 6 linked 5'-region nucleosides;

a central region consisting of 10 linked central region nucleosides; and a 3'-region consisting of 4 linked 3'-region nucleosides; wherein each of the 5'-region nucleosides and each of the 3'-region nucleosides is a 2'-MOE nucleoside, and each of the central region nucleosides is a 2'-β-D-deoxynucleoside.

Embodiment 18. The oligomeric compound of any of embodiments 1-17, wherein the modified oligonucleotide comprises at least one modified internucleoside linkage.

Embodiment 19. The oligomeric compound of embodiment 18, wherein each internucleoside linkage of the modified oligonucleotide is a modified internucleoside linkage.

Embodiment 20. The oligomeric compound of embodiment 18 or embodiment 19, wherein at least one internucleoside linkage is a phosphorothioate internucleoside linkage.

Embodiment 21. The oligomeric compound of embodiment 18 or embodiment 20 wherein the modified oligonucleotide comprises at least one phosphodiester internucleoside linkage.

Embodiment 22. The oligomeric compound of any of embodiments 18, 20, or 21, wherein each internucleoside linkage is either a phosphodiester internucleoside linkage or a phosphorothioate internucleoside linkage.

Embodiment 23. The oligomeric compound of embodiment 19, wherein each internucleoside linkage is a phosphorothioate internucleoside linkage.

Embodiment 24. The oligomeric compound of any of embodiments 1-18 or 20-22, wherein the modified oligonucleotide has an internucleoside linkage motif of sooosssssssssssooss or soooooossssssssssoss; wherein, s=a phosphorothioate internucleoside linkage and o=a phosphodiester internucleoside linkage.

Embodiment 25. The oligomeric compound of any of embodiments 1-24, wherein the modified oligonucleotide comprises at least one modified nucleobase.

Embodiment 26. The oligomeric compound of embodiment 25, wherein the modified nucleobase is a 5-methyl cytosine.

Embodiment 27. The oligomeric compound of any of embodiments 1-26, wherein the modified oligonucleotide consists of 12-30, 12-22, 12-20, 14-18, 14-20, 15-17, 15-25, 16-18, 16-20, 17-20, 18-20 or 18-22 linked nucleosides.

Embodiment 28. The oligomeric compound of any of embodiments 1-26, wherein the modified oligonucleotide consists of 16, 17, 18, 19, or 20 linked nucleosides.

Embodiment 29. The oligomeric compound of embodiment 28, wherein the modified oligonucleotide consists of 20 linked nucleosides.

Embodiment 30. The oligomeric compound of embodiment 28, wherein the modified oligonucleotide consists of 18 linked nucleosides.

Embodiment 31. An oligomeric compound comprising a modified oligonucleotide according to any of the following chemical notations:

(SEQ ID NO: 134)
${}^{m}C_{es}{}^{m}C_{eo}{}^{m}C_{eo}A_{eo}A_{eo}T_{ds}A_{ds}G_{ds}A_{ds}T_{ds}T_{ds}$
${}^{m}C_{ds}A_{ds}A_{ds}{}^{m}C_{ds}T_{eo}A_{eo}G_{es}{}^{m}C_{es}{}^{m}C_{e}$;

(SEQ ID NO: 411)
$A_{es}{}^{m}C_{eo}A_{eo}{}^{m}C_{eo}A_{eo}A_{ds}{}^{m}C_{ds}T_{ds}{}^{m}C_{ds}T_{ds}T_{ds}$
$T_{ds}A_{ds}{}^{m}C_{ds}A_{ds}A_{eo}{}^{m}C_{eo}A_{es}A_{es}A_{e}$;

(SEQ ID NO: 934)
$T_{es}{}^{m}C_{eo}T_{eo}{}^{m}C_{eo}{}^{m}C_{eo}A_{ds}G_{ds}A_{ds}{}^{m}C_{ds}A_{ds}T_{ds}$
$T_{ds}T_{ds}{}^{m}C_{ds}T_{ds}G_{eo}A_{eo}T_{es}G_{es}{}^{m}C_{e}$;

(SEQ ID NO: 1238)
$G_{es}T_{eo}G_{eo}T_{eo}G_{eo}T_{ds}T_{ds}A_{ds}A_{ds}A_{ds}A_{ds}T_{ds}$
$T_{ds}G_{ds}{}^{m}C_{ds}A_{eo}A_{eo}T_{es}T_{es}{}^{m}C_{e}$;

(SEQ ID NO: 2010)
$A_{es}T_{eo}T_{eo}G_{eo}{}^{m}C_{eo}A_{ds}A_{ds}T_{ds}T_{ds}{}^{m}C_{ds}T_{ds}$
$A_{ds}T_{ds}A_{ds}T_{ds}{}^{m}C_{eo}A_{eo}G_{es}A_{es}A_{e}$;

(SEQ ID NO: 1772)
$A_{es}T_{eo}G_{eo}T_{eo}G_{eo}A_{ds}T_{ds}{}^{m}C_{ds}T_{ds}A_{ds}T_{ds}$
$A_{ds}T_{ds}{}^{m}C_{ds}A_{ds}G_{eo}G_{eo}A_{es}G_{es}A_{e}$;
or (SEQ ID NO: 881)
$A_{es}{}^{m}C_{eo}{}^{m}C_{eo}A_{eo}G_{eo}A_{ds}G_{ds}G_{ds}G_{ds}{}^{m}C_{ds}$
${}^{m}C_{ds}A_{ds}T_{ds}{}^{m}C_{ds}T_{ds}{}^{m}C_{eo}A_{eo}G_{es}G_{es}T_{e}$ (SEQ ID NO: 2101)
$T_{es}G_{eo}T_{eo}A_{eo}G_{eo}T_{ds}A_{ds}{}^{m}C_{ds}A_{ds}A_{ds}A_{ds}$
$T_{ds}{}^{m}C_{ds}T_{ds}T_{ds}T_{eo}{}^{m}C_{eo}{}^{m}C_{es}T_{es}T_{e}$;

(SEQ ID NO: 1050)
$G_{e}S{}^{m}C_{eo}A_{eo}T_{eo}{}^{m}C_{eo}A_{ds}G_{ds}A_{ds}T_{ds}G_{ds}T_{ds}$
$T_{ds}{}^{m}C_{ds}A_{ds}T_{ds}{}^{m}C_{eo}T_{eo}{}^{m}C_{es}T_{es}T_{e}$;

(SEQ ID NO: 1449)
${}^{m}C_{es}{}^{m}C_{eo}T_{eo}{}^{m}C_{eo}{}^{m}C_{eo}A_{ds}T_{ds}T_{ds}{}^{m}C_{ds}$
${}^{m}C_{ds}T_{ds}T_{ds}T_{ds}G_{ds}T_{ds}G_{eo}A_{eo}{}^{m}C_{es}T_{es}T_{e}$, wherein:

A=an adenine nucleobase,
${}^{m}C$=a 5-methyl cytosine nucleobase,
G=a guanine nucleobase,
T=a thymine nucleobase,
e=a 2'-MOE sugar moiety,
d=a 2'-β-D-deoxyribosyl sugar moiety,
s=a phosphorothioate internucleoside linkage, and
o=a phosphodiester internucleoside linkage.

Embodiment 32. An oligomeric compound comprising a modified oligonucleotide according to the following chemical notation:

(SEQ ID NO: 2101)
$T_{es}G_{eo}T_{eo}A_{eo}G_{eo}T_{ds}A_{ds}{}^{m}C_{ds}A_{ds}A_{ds}A_{ds}$
$T_{ds}{}^{m}C_{ds}T_{ds}T_{ds}T_{eo}{}^{m}C_{eo}{}^{m}C_{es}T_{es}T_{e}$, wherein:

A=an adenine nucleobase,
${}^{m}C$=a 5-methyl cytosine nucleobase,
G=a guanine nucleobase,
T=a thymine nucleobase,
e=a 2'-MOE sugar moiety,
d=a 2'-β-D-deoxyribosyl sugar moiety,
s=a phosphorothioate internucleoside linkage, and
o=a phosphodiester internucleoside linkage.

Embodiment 33. An oligomeric compound comprising a modified oligonucleotide according to the following chemical notation:

(SEQ ID NO: 682)
$A_{es}{}^{m}C_{eo}A_{eo}A_{eo}A_{eo}T_{eo}{}^{m}C_{ds}T_{ds}T_{ds}T_{ds}{}^{m}C_{ds}$
${}^{m}C_{ds}T_{ds}T_{ds}{}^{m}C_{ds}A_{ds}A_{eo}T_{es}T_{es}A_{e}$, wherein:

A=an adenine nucleobase,
${}^{m}C$=a 5-methyl cytosine nucleobase,
G=a guanine nucleobase,
T=a thymine nucleobase,
e=a 2'-MOE sugar moiety,
d=a 2'-β-D-deoxyribosyl sugar moiety,
s=a phosphorothioate internucleoside linkage, and
o=a phosphodiester internucleoside linkage.

Embodiment 34. An oligomeric compound comprising a modified oligonucleotide according to the following chemical notation:

(SEQ ID NO: 1124)
${}^{m}C_{es}A_{eo}G_{eo}A_{eo}T_{eo}G_{eo}T_{ds}T_{ds}{}^{m}C_{ds}A_{ds}T_{ds}$
${}^{m}C_{ds}T_{ds}{}^{m}C_{ds}T_{ds}T_{ds}{}^{m}C_{eo}A_{es}{}^{m}C_{es}A_{e}$, wherein:

A=an adenine nucleobase,
${}^{m}C$=a 5-methyl cytosine nucleobase,
G=a guanine nucleobase,
T=a thymine nucleobase,
e=a 2'-MOE sugar moiety,
d=a 2'-β-D-deoxyribosyl sugar moiety,
s=a phosphorothioate internucleoside linkage, and
o=a phosphodiester internucleoside linkage.

Embodiment 35. An oligomeric compound comprising a modified oligonucleotide according to the following chemical notation:

(SEQ ID NO: 2145)
${}^{m}C_{es}A_{eo}T_{eo}{}^{m}C_{eo}A_{eo}G_{eo}A_{ds}T_{ds}G_{ds}T_{ds}T_{ds}$
${}^{m}C_{ds}A_{ds}T_{ds}{}^{m}C_{ds}T_{ds}{}^{m}C_{eo}T_{es}T_{es}{}^{m}C_{e}$,

A=an adenine nucleobase,
${}^{m}C$=a 5-methyl cytosine nucleobase,
G=a guanine nucleobase,
T=a thymine nucleobase,
e=a 2'-MOE sugar moiety,
d=a 2'-β-D-deoxyribosyl sugar moiety,
s=a phosphorothioate internucleoside linkage, and
o=a phosphodiester internucleoside linkage.

Embodiment 36. The oligomeric compound of any of embodiments 1-35 wherein the oligomeric compound is a singled-stranded oligomeric compound.

Embodiment 37. The oligomeric compound of any of embodiments 1-36, consisting of the modified oligonucleotide.

Embodiment 38. The oligomeric compound of any of embodiments 1-36, further comprising a conjugate group.

Embodiment 39. The oligomeric compound of embodiment 38, wherein the conjugate group comprises a conjugate moiety and a conjugate linker.

Embodiment 40. The oligomeric compound of embodiment 38, wherein the conjugate group comprises a GalNAc cluster comprising 1-3 GalNAc ligands.

Embodiment 41. The oligomeric compound of embodiment 38 or embodiment 39, wherein the conjugate linker consists of a single bond.

Embodiment 42. The oligomeric compound of and of embodiments 39 or embodiment 41, wherein the conjugate linker is cleavable.

Embodiment 43. The oligomeric compound of embodiment 39 or embodiment 42, wherein the conjugate linker comprises 1-3 linker-nucleosides.

Embodiment 44. The oligomeric compound of any of embodiments 38-43, wherein the conjugate group is attached to the modified oligonucleotide at the 5'-end of the modified oligonucleotide.

Embodiment 45. The oligomeric compound of any of embodiments 38-43, wherein the conjugate group is attached to the modified oligonucleotide at the 3'-end of the modified oligonucleotide.

Embodiment 46. The oligomeric compound of any of embodiments 1-36 or 38-45 further comprising a terminal group.

Embodiment 47. The oligomeric compound of any of embodiments 1-42 or 44-46, wherein the oligomeric compound does not comprise linker-nucleosides.

Embodiment 48. The oligomeric compound of any of embodiments 1-47, wherein the modified oligonucleotide of the oligomeric compound is a salt, and wherein the salt is a sodium salt or a potassium salt.

Embodiment 49. The oligomeric compound of any of embodiments 1-48, wherein the modified oligonucleotide is an RNAi compound.

Embodiment 50. An oligomeric duplex comprising an oligomeric compound of any of embodiments 1-35 or 37-49.

Embodiment 51. An antisense compound comprising or consisting of an oligomeric compound of any of embodiments 1-49 or an oligomeric duplex of embodiment 50.

Embodiment 52. A modified oligonucleotide according to the following chemical structure:

(SEQ ID NO: 2101)
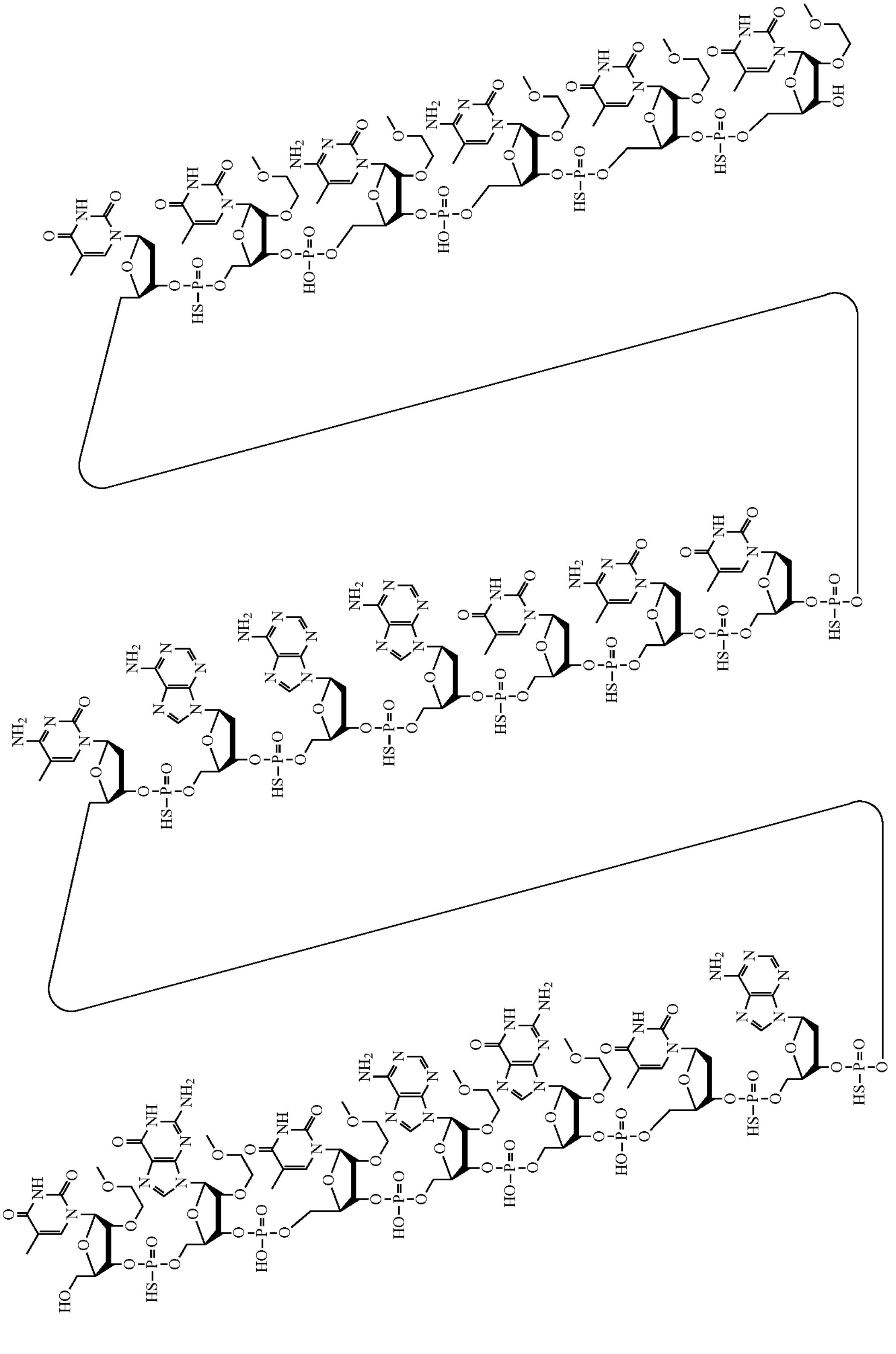

or a salt thereof.

Embodiment 53. The modified oligonucleotide of embodiment 52, which is the sodium salt or the potassium salt.

Embodiment 54. A modified oligonucleotide according to the following chemical structure:

(SEQ ID NO: 2101)
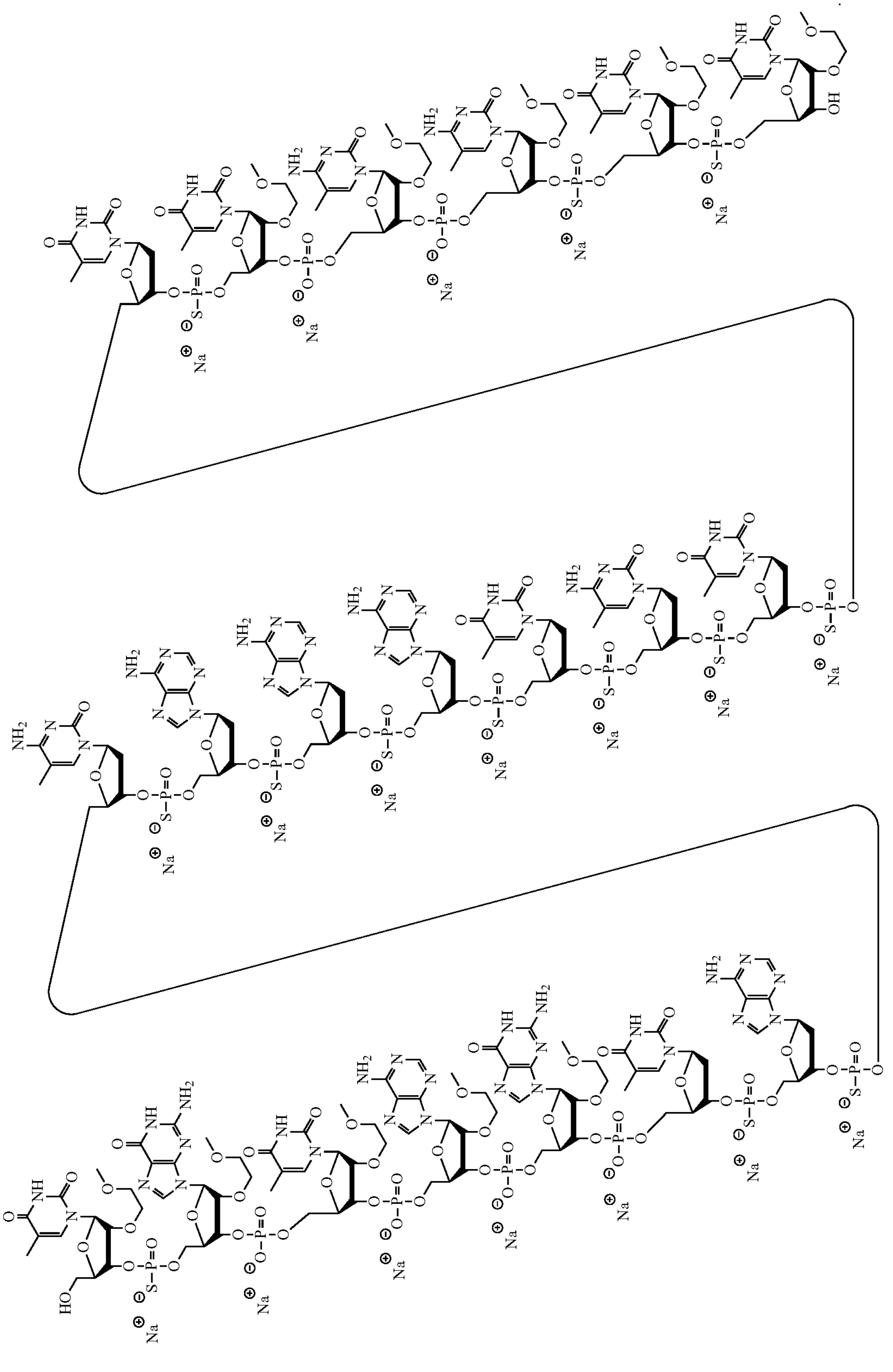

Embodiment 55. A modified oligonucleotide according to the following chemical structure:

(SEQ ID NO: 682)
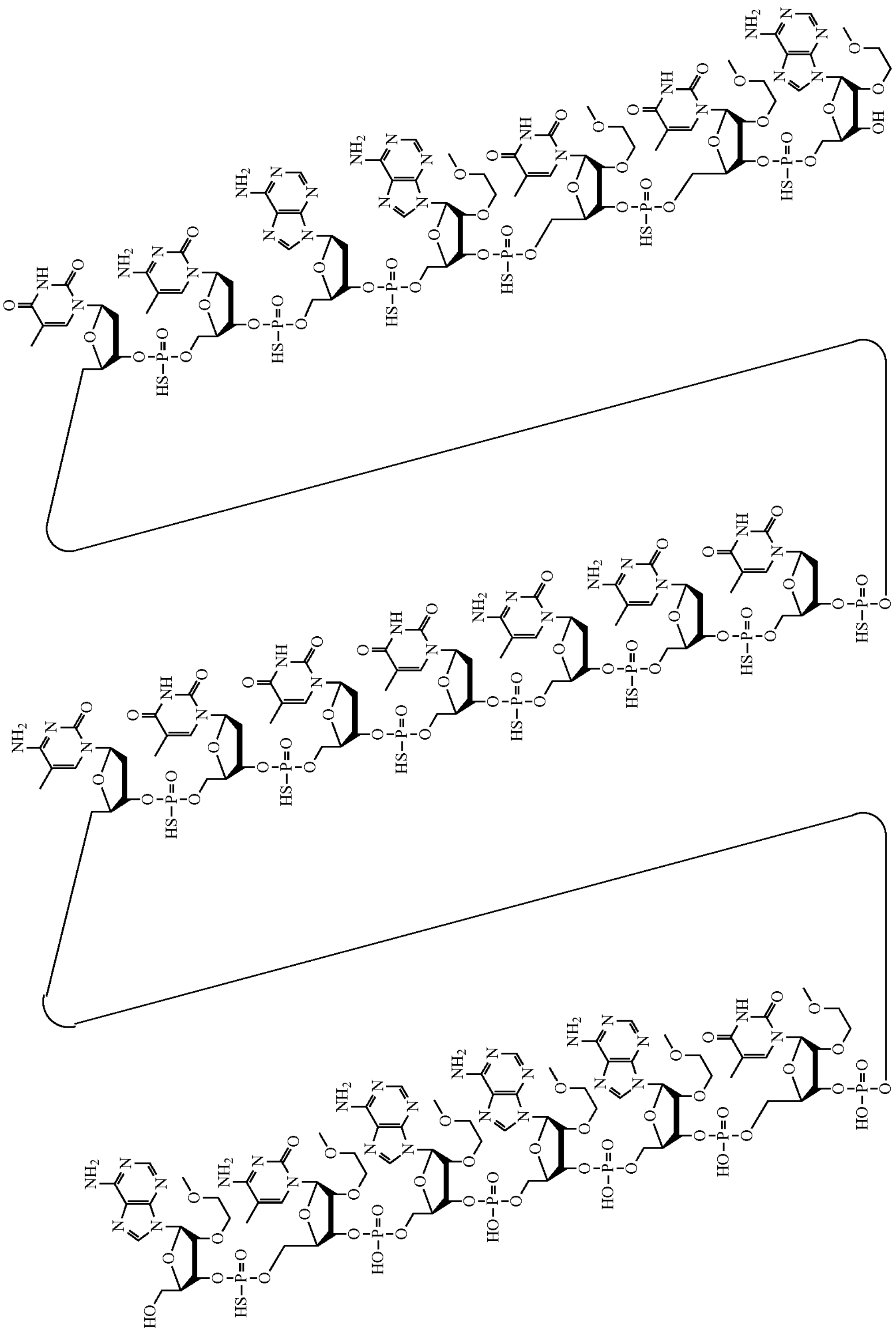

or a salt thereof.
Embodiment 56. The modified oligonucleotide of embodiment 55, which is the sodium salt or the potassium salt.
Embodiment 57. A modified oligonucleotide according to the following chemical structure:
(SEQ ID NO: 682)
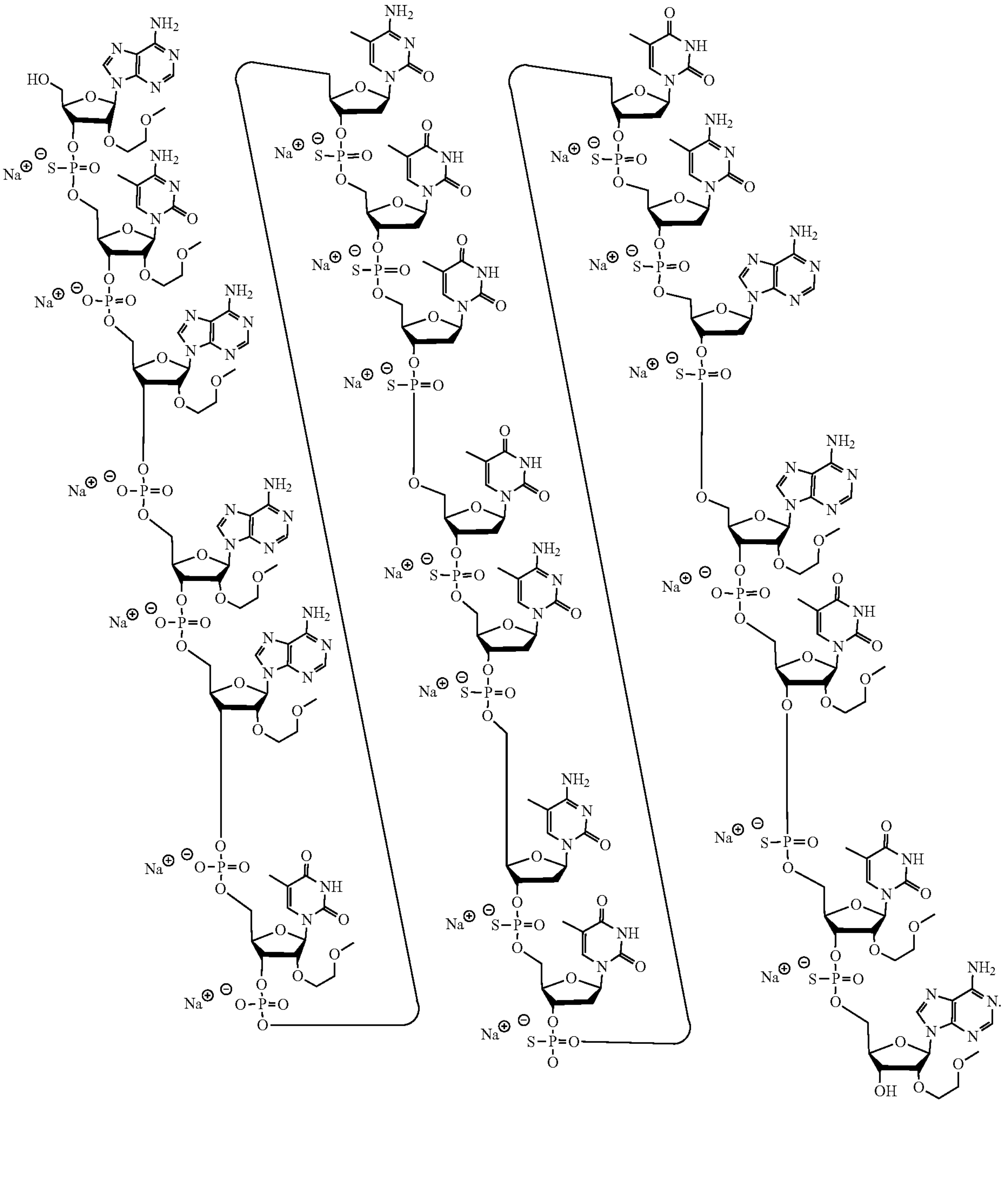

Embodiment 58. A modified oligonucleotide according to the following chemical structure:
(SEQ ID NO: 1124)
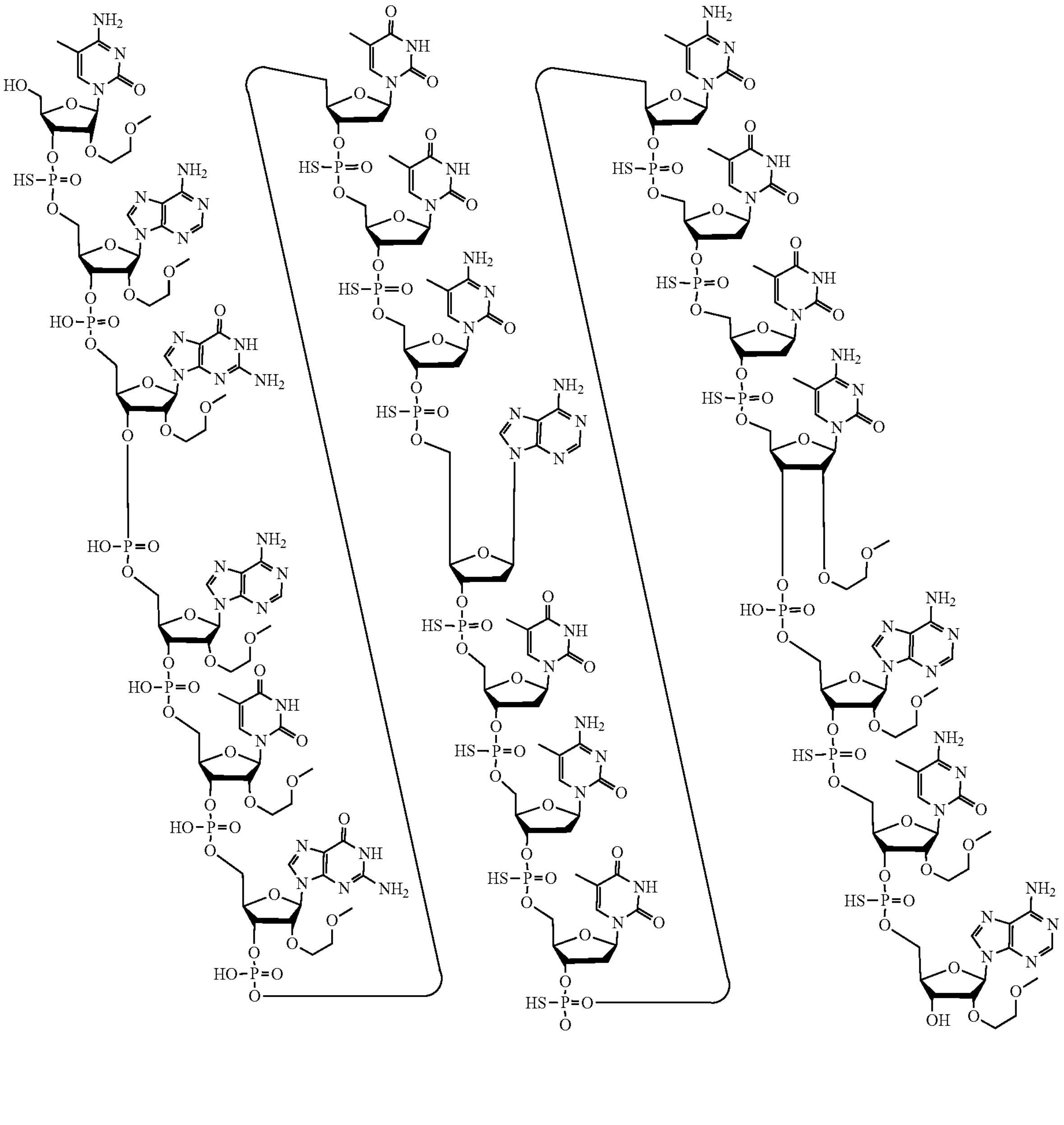
or a salt thereof.
Embodiment 59. The modified oligonucleotide of embodiment 58, which is the sodium salt or the potassium salt.

Embodiment 60. A modified oligonucleotide according to the following chemical structure:
(SEQ ID NO: 1124)
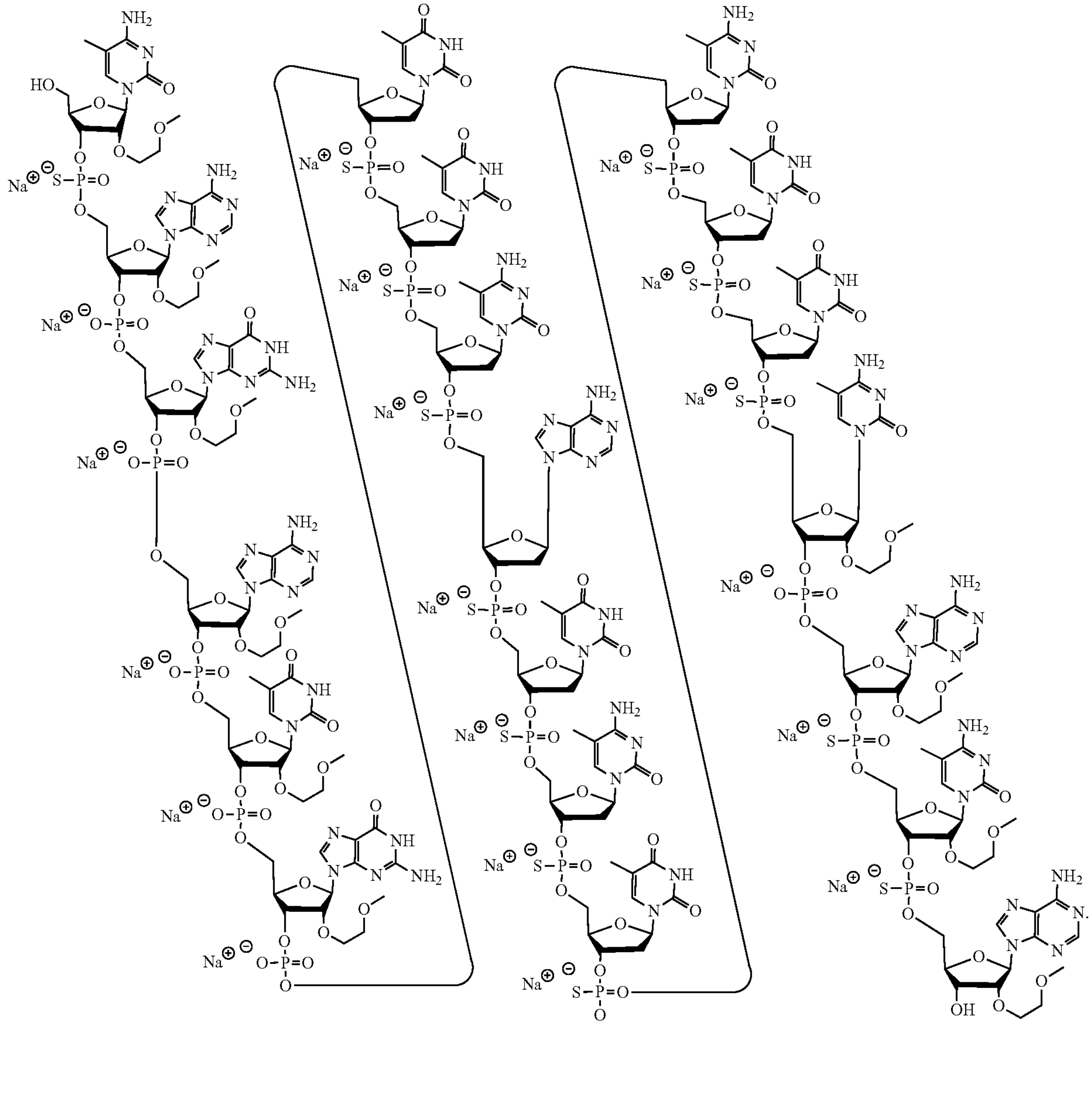

Embodiment 61. A modified oligonucleotide according to the following chemical structure:
(SEQ ID NO: 2145)
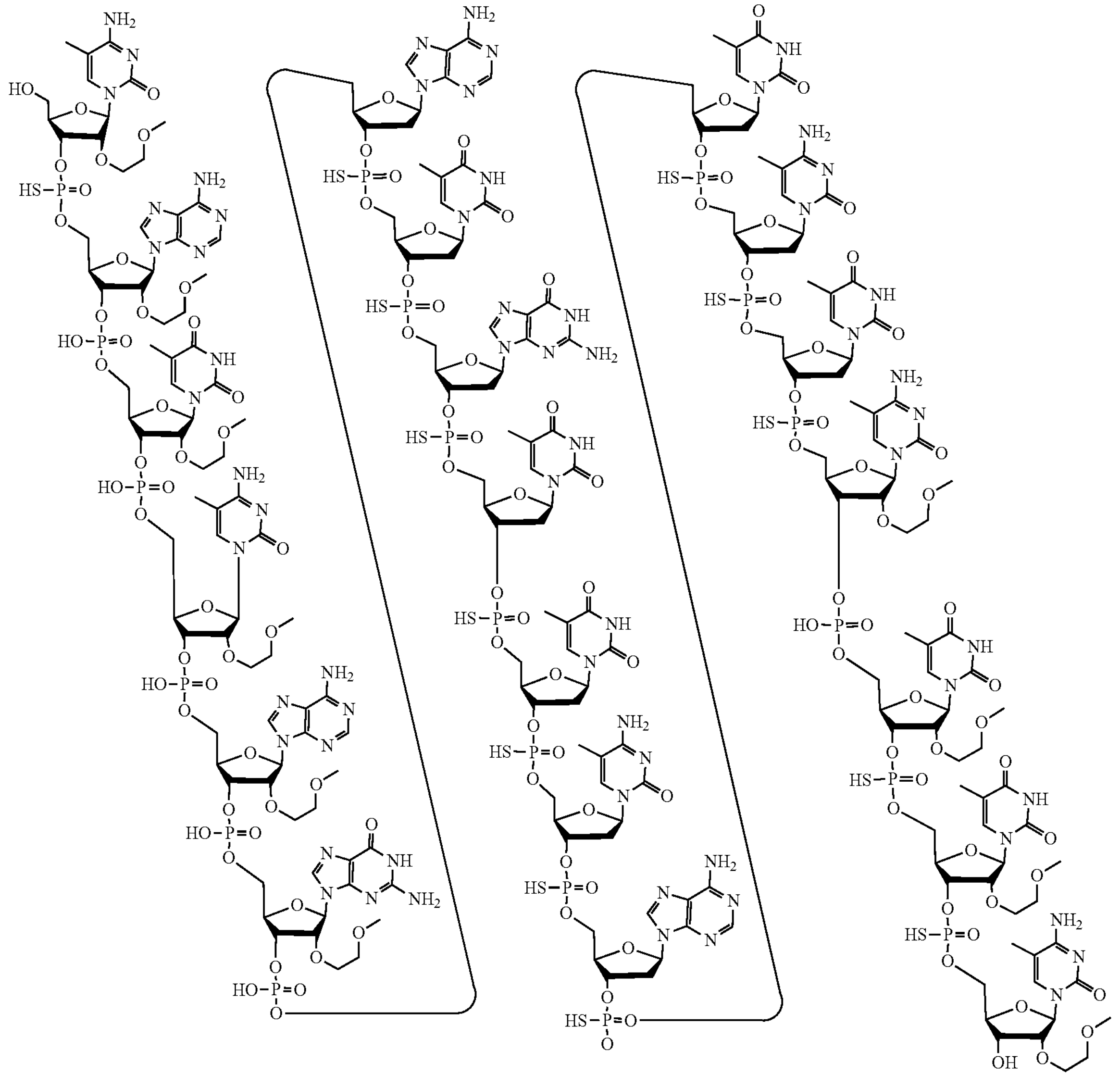
or a salt thereof.
Embodiment 62. The modified oligonucleotide of embodiment 61, which is the sodium salt or the potassium salt.

Embodiment 63. A modified oligonucleotide according to the following chemical structure:

(SEQ ID NO: 2145)

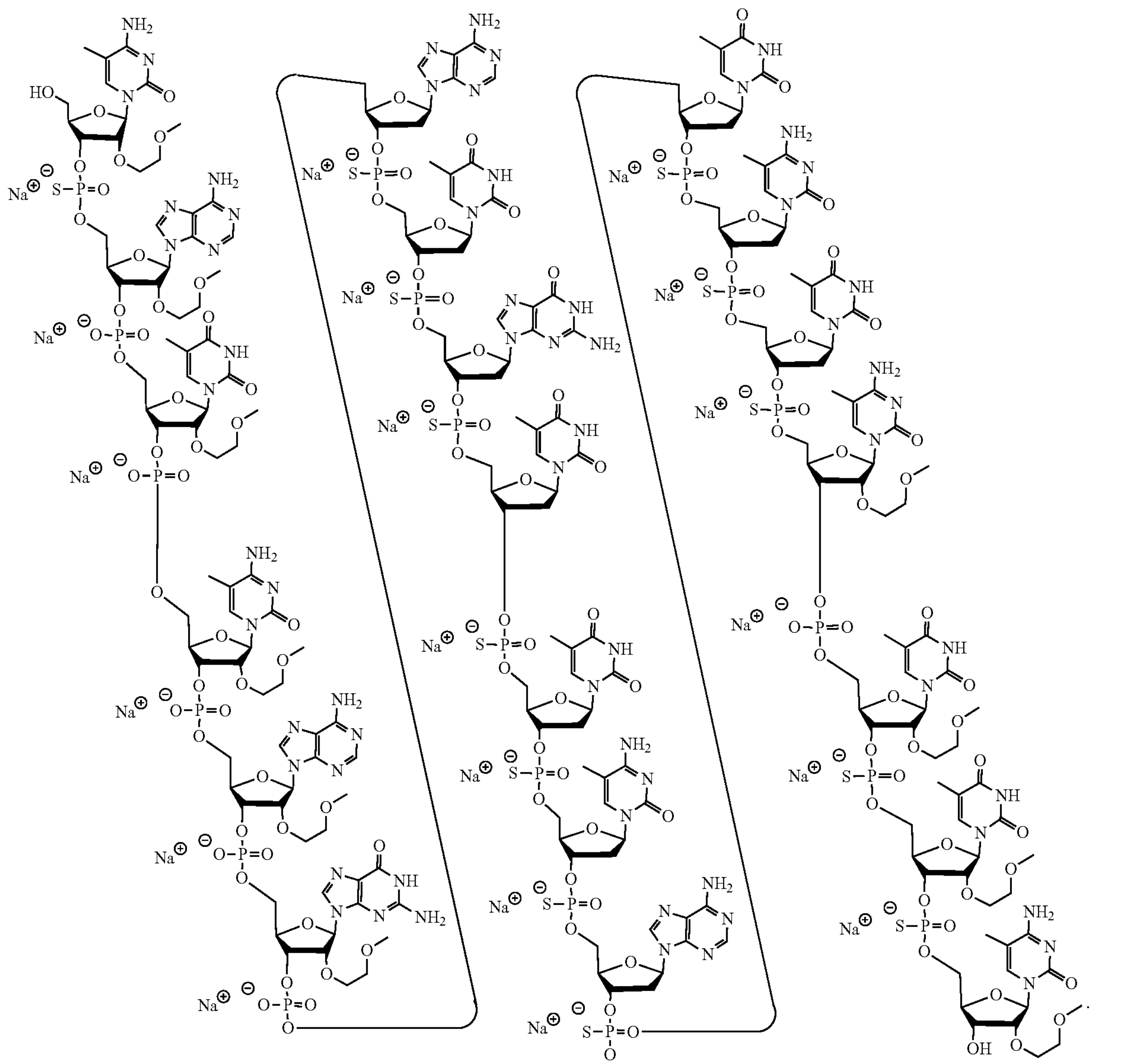

Embodiment 64. A pharmaceutical composition comprising the oligomeric compound of any of embodiments 1-49, the oligomeric duplex of embodiment 50, the antisense compound of embodiment 51, or the modified oligonucleotide of any of embodiments 52-63 and a pharmaceutically acceptable diluent or carrier.

Embodiment 65. The pharmaceutical composition of embodiment 64, comprising a pharmaceutically acceptable diluent and wherein the pharmaceutically acceptable diluent is artificial cerebrospinal fluid (aCSF) or phosphate-buffered saline (PBS).

Embodiment 66. The pharmaceutical composition of embodiment 65, wherein the pharmaceutical composition consists essentially of the oligomeric compound or the modified oligonucleotide and aCSF.

Embodiment 67. The pharmaceutical composition of embodiment 65, wherein the pharmaceutical composition consists essentially of the oligomeric compound or the modified oligonucleotide and PBS.

Embodiment 68. A pharmaceutical composition comprising a modified oligonucleotide of any of embodiments 52-63 and a pharmaceutically acceptable diluent.

Embodiment 69. The pharmaceutical composition of embodiment 68, wherein the pharmaceutically acceptable diluent is artificial cerebrospinal fluid (aCSF) or phosphate-buffered saline (PBS).

Embodiment 70. The pharmaceutical composition of embodiment 69, wherein the pharmaceutical composition consists essentially of the modified oligonucleotide and aCSF.

Embodiment 71. The pharmaceutical composition of embodiment 69, wherein the pharmaceutical composition consists essentially of the modified oligonucleotide and PBS.

Embodiment 72. A pharmaceutical composition comprising an oligomeric compound of any of embodiments 32-35 and a pharmaceutically acceptable diluent.

Embodiment 73. The pharmaceutical composition of embodiment 72, wherein the pharmaceutically acceptable diluent is artificial cerebrospinal fluid (aCSF) or phosphate-buffered saline (PBS).

Embodiment 74. The pharmaceutical composition of embodiment 73, wherein the pharmaceutical composition consists essentially of the oligomeric compound and aCSF.

Embodiment 75. The pharmaceutical composition of embodiment 73, wherein the pharmaceutical composition consists essentially of the oligomeric compound and PBS.

Embodiment 76. A chirally enriched population of modified oligonucleotides of any of embodiments 52-63, wherein the population is enriched for modified oligonucleotides comprising at least one particular phosphorothioate internucleoside linkage having a particular stereochemical configuration.

Embodiment 77. The chirally enriched population of embodiment 76, wherein the population is enriched for modified oligonucleotides comprising at least one particular phosphorothioate internucleoside linkage having the (Sp) configuration.

Embodiment 78. The chirally enriched population of embodiment 76, wherein the population is enriched for modified oligonucleotides comprising at least one particular phosphorothioate internucleoside linkage having the (Rp) configuration.

Embodiment 79. The chirally enriched population of embodiment 76, wherein the population is enriched for modified oligonucleotides having a particular, independently selected stereochemical configuration at each phosphorothioate internucleoside linkage.

Embodiment 80. The chirally enriched population of embodiment 79, wherein the population is enriched for modified oligonucleotides having the (Sp) configuration at each phosphorothioate internucleoside linkage or for modified oligonucleotides having the (Rp) configuration at each phosphorothioate internucleoside linkage.

Embodiment 81. The chirally enriched population of embodiment 79, wherein the population is enriched for modified oligonucleotides having the (Rp) configuration at one particular phosphorothioate internucleoside linkage and the (Sp) configuration at each of the remaining phosphorothioate internucleoside linkages.

Embodiment 82. The chirally enriched population of embodiment 79, wherein the population is enriched for modified oligonucleotides having at least 3 contiguous phosphorothioate internucleoside linkages in the Sp, Sp, and Rp configurations, in the 5' to 3' direction.

Embodiment 83. A population of modified oligonucleotides of any of embodiments 52-63, wherein all of the phosphorothioate internucleoside linkages of the modified oligonucleotide are stereorandom.

Embodiment 84. A chirally enriched population of oligomeric compounds of any of embodiments 32-35, wherein the population is enriched for oligomeric compounds comprising at least one particular phosphorothioate internucleoside linkage having a particular stereochemical configuration.

Embodiment 85. The chirally enriched population of embodiment 84, wherein the population is enriched for oligomeric compounds comprising at least one particular phosphorothioate internucleoside linkage having the (Sp) configuration.

Embodiment 86. The chirally enriched population of embodiment 84, wherein the population is enriched for oligomeric compounds comprising at least one particular phosphorothioate internucleoside linkage having the (Rp) configuration.

Embodiment 87. The chirally enriched population of embodiment 84, wherein the population is enriched for oligomeric compounds having a particular, independently selected stereochemical configuration at each phosphorothioate internucleoside linkage.

Embodiment 88. The chirally enriched population of embodiment 87, wherein the population is enriched for oligomeric compounds having the (Sp) configuration at each phosphorothioate internucleoside linkage or for modified oligonucleotides having the (Rp) configuration at each phosphorothioate internucleoside linkage.

Embodiment 89. The chirally enriched population of embodiment 87, wherein the population is enriched for oligomeric compounds having the (Rp) configuration at one particular phosphorothioate internucleoside linkage and the (Sp) configuration at each of the remaining phosphorothioate internucleoside linkages.

Embodiment 90. The chirally enriched population of embodiment 87, wherein the population is enriched for oligomeric compounds having at least 3 contiguous phosphorothioate internucleoside linkages in the Sp, Sp, and Rp configurations, in the 5' to 3' direction.

Embodiment 91. A population of oligomeric compounds of any of embodiments 32-35, wherein all of the phosphorothioate internucleoside linkages of the modified oligonucleotide are stereorandom.

Embodiment 92. A pharmaceutical composition comprising the chirally enriched population of any of embodiments 76-82 or 84-90, the population of embodiment 83, or the population of embodiment 91 and a pharmaceutically acceptable diluent.

Embodiment 93. The pharmaceutical composition of embodiment 92, wherein the pharmaceutically acceptable diluent is artificial CSF (aCSF) or phosphate-buffered saline (PBS).

Embodiment 94. The pharmaceutical composition of embodiment 93, wherein the pharmaceutical composition consists essentially of the oligomeric compounds or the modified oligonucleotides and artificial CSF (aCSF).

Embodiment 95. The pharmaceutical composition of embodiment 93, wherein the pharmaceutical composition consists essentially of the oligomeric compounds or the modified oligonucleotides and PBS.

Embodiment 96. A method comprising administering to an animal the pharmaceutical composition of any of embodiments 64-75 or 92-95.

Embodiment 97. A method of treating a disease or disorder associated with PLP1, comprising administering to a subject having or at risk for developing a disease or disorder associated with PLP1 a therapeutically effective amount of a pharmaceutical composition according to any of embodiments 64-75 or 92-95, and thereby treating the disease or disorder associated with PLP1.

Embodiment 98. A method of reducing PLP1 protein in the CSF of a subject having or at risk for developing a disease or disorder associated with PLP1 a therapeutically effective amount of a pharmaceutical composition according any of embodiments 64-75 or 92-95, and thereby reducing PLP1 protein in the CSF.

Embodiment 99. The method of embodiment 97 or embodiment 98, wherein the disease or disorder associated with PLP1 is a neurodegenerative disease.

Embodiment 100. The method of any of embodiments 97-99, wherein the disease or disorder associated with PLP1 is a leukodystrophy.

Embodiment 101. The method of embodiment 100, wherein the leukodystrophy is PMD.

Embodiment 102. The method of embodiment 101, wherein the PMD is any of connatal PMD, classic PMD, transitional PMD.

Embodiment 103. The method of embodiment 101, wherein the PMD is caused by overexpression of PLP1 protein.

Embodiment 104. The method of embodiment 101, wherein the PMD is caused by multiple copies of the PLP1 gene.

Embodiment 105. The method of embodiment 101, wherein the PMD is caused by the expression of duplicate copies of the PLP1 gene.

Embodiment 106. The method of any of embodiments 100-105, wherein at least one symptom or hallmark of the leukodystrophy is ameliorated.

Embodiment 107. The method of embodiment 97 or embodiment 98, wherein the disease or disorder associated with PLP1 is SPG2.

Embodiment 108. The method of embodiment 107, wherein at least one symptom or hallmark of SPG2 is ameliorated.

Embodiment 109. The method of embodiment 106 or embodiment 108, wherein the symptom or hallmark is any of hypotonia, nystagmus, optic atrophy, respiratory distress, motor delays, cognitive dysfunction, speech dysfunction, spasticity, ataxia, seizures, choreiform movements, and death.

Embodiment 110. The method of any of embodiments 96-109 wherein administering the modified oligonucleotide reduces hypotonia, nystagmus, optic atrophy, respiratory distress, motor delays, cognitive dysfunction, speech dysfunction, spasticity, ataxia, seizures, or choreiform movements, or delays death in the subject.

Embodiment 111. The method of any of embodiments 96-110, wherein the pharmaceutical composition is administered to the central nervous system or systemically.

Embodiment 112. The method of embodiment 111, wherein the pharmaceutical composition is administered to the central nervous system and systemically.

Embodiment 113. The method of any of embodiments 96-110, wherein the pharmaceutical composition is administered any of intrathecally, systemically, subcutaneously, or intramuscularly.

Embodiment 114. A method of reducing PLP1 RNA in a cell comprising contacting the cell with an oligomeric compound of any of embodiments 1-49, an oligomeric duplex according to embodiment 50, an antisense compound according to embodiment 51, or a modified oligonucleotide of any of embodiments 52-63, and thereby reducing PLP1 RNA in the cell.

Embodiment 115. A method of reducing PLP1 protein in a cell comprising contacting the cell with an oligomeric compound of any of embodiments 1-49, an oligomeric duplex according to embodiment 50, an antisense compound according to embodiment 51, or a modified oligonucleotide of any of embodiments 52-63, and thereby reducing PLP1 protein in the cell.

Embodiment 116. The method of embodiment 114 or embodiment 115, wherein the cell is an oligodendrocyte or an oligodendrocyte progenitor cell.

Embodiment 117. The method of embodiment 114 or embodiment 115, wherein the cell is a Schwann cell or a Schwann cell progenitor.

Embodiment 118. The method of any of embodiments 114-117, wherein the cell is in an animal.

Embodiment 119. The method of embodiment 96 or embodiment 118, wherein the animal is human.

Embodiment 120. A method comprising administering to a subject a pharmaceutical composition of any of embodiments 68-71.

Embodiment 121. A method of treating a disease or disorder associated with PLP1, comprising administering to an subject having or at risk for developing a disease or disorder associated with PLP1 a therapeutically effective amount of a pharmaceutical composition according to any of embodiments 68-71 and thereby treating the disease or disorder associated with PLP1.

Embodiment 122. The method of embodiment 121, wherein the disease associated with PLP1 is a neurodegenerative disease.

Embodiment 123. The method of embodiment 122, wherein the neurodegenerative disease is a leukodystrophy.

Embodiment 124. The method of embodiment 123, wherein the leukodystrophy is PMD.

Embodiment 125. The method of embodiment 124, wherein the PMD is any of connatal PMD, classic PMD, transitional PMD.

Embodiment 126. The method of embodiment 124, wherein the PMD is caused by overexpression of PLP1 protein.

Embodiment 127. The method of embodiment 124, wherein the PMD is caused by multiple copies of the PLP1 gene.

Embodiment 128. The method of embodiment 124, wherein the PMD is caused by the expression of duplicate copies of the PLP1 gene.

Embodiment 129. The method of any of embodiments 122-128, wherein at least one symptom or hallmark of the neurodegenerative disease is ameliorated.

Embodiment 130. The method of embodiment 129, wherein the symptom or hallmark is any of hypotonia, nystagmus, optic atrophy, respiratory distress, motor delays, cognitive dysfunction, speech dysfunction, spasticity, ataxia, seizures, choreiform movements, and death.

Embodiment 131. The method of any of embodiments 121-130 wherein administering the pharmaceutical composition reduces hypotonia, nystagmus, optic atrophy, respiratory distress, motor delays, cognitive dysfunction, speech dysfunction, spasticity, ataxia, seizures, or choreiform movements, or delays death in the subject.

Embodiment 132. The method of any of embodiments 120-131, wherein the subject is human.

Embodiment 133. A method of reducing expression of PLP1 in a cell comprising contacting the cell with a modified oligonucleotide of any of embodiments 52-63.

Embodiment 134. The method of embodiment 133, wherein the cell is a human cell.

Embodiment 135. Use of an oligomeric compound any of embodiments 1-49, an oligomeric duplex according to embodiment 50, an antisense compound according to embodiment 51, or a modified oligonucleotide of any of embodiments 52-63 for reducing PLP1 expression in a cell.

Embodiment 136. The use of embodiment 135, wherein the level of PLP1 RNA in the cell is reduced.

Embodiment 137. The use of embodiment 135, wherein the level of PLP1 protein in the cell is reduced.

Embodiment 138. The use of any of embodiments 133-137, wherein the cell is an oligodendrocyte or an oligodendrocyte progenitor cell.

Embodiment 139. The use of any of embodiments 133-137, wherein the cell is a Schwann cell or a Schwann cell progenitor.

Certain Oligonucleotides

In certain embodiments, provided herein are oligomeric compounds comprising oligonucleotides, which consist of linked nucleosides. Oligonucleotides may be unmodified oligonucleotides (RNA or DNA) or may be modified oligonucleotides. Modified oligonucleotides comprise at least one modification relative to unmodified RNA or DNA. That is, modified oligonucleotides comprise at least one modified nucleoside (comprising a modified sugar moiety and/or a modified nucleobase) and/or at least one modified internucleoside linkage.

A. Certain Modified Nucleosides

Modified nucleosides comprise a modified sugar moiety or a modified nucleobase or both a modified sugar moiety and a modified nucleobase.

1. Certain Sugar Moieties

In certain embodiments, modified sugar moieties are non-bicyclic modified sugar moieties. In certain embodiments, modified sugar moieties are bicyclic or tricyclic sugar moieties. In certain embodiments, modified sugar moieties are sugar surrogates. Such sugar surrogates may comprise one or more substitutions corresponding to those of other types of modified sugar moieties.

In certain embodiments, modified sugar moieties are non-bicyclic modified sugar moieties comprising a furanosyl ring with one or more substituent groups none of which bridges two atoms of the furanosyl ring to form a bicyclic structure. Such non bridging substituents may be at any position of the furanosyl, including but not limited to substituents at the 2', 4', and/or 5' positions. In certain embodiments one or more non-bridging substituent of non-bicyclic modified sugar moieties is branched. Examples of 2'-substituent groups suitable for non-bicyclic modified sugar moieties include but are not limited to: 2'-F, 2'-$OCH_3$ ("OMe" or "O-methyl"), and 2'-$O(CH_2)_2OCH_3$ ("MOE" or "O-methoxyethyl"). In certain embodiments, 2'-substituent groups are selected from among: halo, allyl, amino, azido, SH, CN, OCN, $CF_3$, $OCF_3$, O—$C_1$-$C_{10}$ alkoxy, O—$C_1$-$C_{10}$ substituted alkoxy, O—$C_1$-$C_{10}$ alkyl, O—$C_1$-$C_{10}$ substituted alkyl, S-alkyl, $N(R_m)$-alkyl, O-alkenyl, S-alkenyl, $N(R_m)$-alkenyl, O-alkynyl, S-alkynyl, $N(R_m)$-alkynyl, O-alkylenyl-O-alkyl, alkynyl, alkaryl, aralkyl, O-alkaryl, O-aralkyl, $O(CH_2)_2SCH_3$, $O(CH_2)_2ON(R_m)(R_n)$ or $OCH_2C(=O)$—$N(R_m)(R_n)$, where each $R_m$ and $R_n$ is, independently, H, an amino protecting group, or substituted or unsubstituted $C_1$-$C_{10}$ alkyl, and the 2'-substituent groups described in Cook et al., U.S. Pat. No. 6,531,584; Cook et al., U.S. Pat. No. 5,859,221; and Cook et al., U.S. Pat. No. 6,005,087. Certain embodiments of these 2'-substituent groups can be further substituted with one or more substituent groups independently selected from among: hydroxyl, amino, alkoxy, carboxy, benzyl, phenyl, nitro ($NO_2$), thiol, thioalkoxy, thioalkyl, halogen, alkyl, aryl, alkenyl and alkynyl. Examples of 4'-substituent groups suitable for non-bicyclic modified sugar moieties include but are not limited to alkoxy (e.g., methoxy), alkyl, and those described in Manoharan et al., WO 2015/106128. Examples of 5'-substituent groups suitable for non-bicyclic modified sugar moieties include but are not limited to: 5'-methyl (R or S), 5'-vinyl, and 5'-methoxy. In certain embodiments, non-bicyclic modified sugar moieties comprise more than one non-bridging sugar substituent, for example, 2'-F-5'-methyl sugar moieties and the modified sugar moieties and modified nucleosides described in Migawa et al., WO 2008/101157 and Rajeev et al., US2013/0203836.

In certain embodiments, a 2'-substituted non-bicyclic modified nucleoside comprises a sugar moiety comprising a non-bridging 2'-substituent group selected from: F, $NH_2$, $N_3$, $OCF_3$, $OCH_3$, $O(CH_2)_3NH_2$, $CH_2CH=CH_2$, $OCH_2CH=CH_2$, $OCH_2CH_2OCH_3$, $O(CH_2)_2SCH_3$, $O(CH_2)_2ON(R_m)(R_n)$, $O(CH_2)_2O(CH_2)_2N(CH_3)_2$, and N-substituted acetamide ($OCH_2C(=O)$—$N(R_m)(R_n)$), where each $R_m$ and $R_n$ is, independently, H, an amino protecting group, or substituted or unsubstituted $C_1$-$C_{10}$ alkyl.

In certain embodiments, a 2'-substituted non-bicyclic modified nucleoside comprises a sugar moiety comprising a non-bridging 2'-substituent group selected from: F, $OCF_3$, $OCH_3$, $OCH_2CH_2OCH_3$, $O(CH_2)_2SCH_3$, $O(CH_2)_2ON(CH_3)_2$, $O(CH_2)_2O(CH_2)_2N(CH_3)_2$, and $OCH_2C(=O)$—$N(H)CH_3$ ("NMA").

In certain embodiments, a 2'-substituted non-bicyclic modified nucleoside comprises a sugar moiety comprising a non-bridging 2'-substituent group selected from: F, $OCH_3$, and $OCH_2CH_2OCH_3$.

In certain embodiments, modified furanosyl sugar moieties and nucleosides incorporating such modified furanosyl sugar moieties are further defined by isomeric configuration. For example, a 2'-deoxyfuranosyl sugar moiety may be in seven isomeric configurations other than the naturally occurring β-D-deoxyribosyl configuration. Such modified sugar moieties are described in, e.g., WO 2019/157531, incorporated by reference herein. A 2'-modified sugar moiety has an additional stereocenter at the 2'-position relative to a 2'-deoxyfuranosyl sugar moiety; therefore, such sugar moieties have a total of sixteen possible isomeric configurations. 2'-modified sugar moieties described herein are in the β-D-ribosyl isomeric configuration unless otherwise specified.

Certain modified sugar moieties comprise a substituent that bridges two atoms of the furanosyl ring to form a second ring, resulting in a bicyclic sugar moiety. Nucleosides comprising such bicyclic sugar moieties have been referred to as bicyclic nucleosides (BNAs), locked nucleosides, or conformationally restricted nucleotides (CRN). Certain such compounds are described in US Patent Publication No. 2013/0190383; and PCT publication WO 2013/036868. In certain such embodiments, the bicyclic sugar moiety comprises a bridge between the 4' and the 2' furanose ring atoms. In certain such embodiments, the furanose ring is a ribose ring. Examples of such 4' to 2' bridging sugar substituents include but are not limited to: 4'-$CH_2$-2', 4'-$(CH_2)_2$-2', 4'-$(CH_2)_3$-2', 4'-$CH_2$—O-2' ("LNA"), 4'-$CH_2$—S-2', 4'-$(CH_2)_2$—O-2' ("ENA"), 4'-$CH(CH_3)$—O-2' (referred to as "constrained ethyl" or "cEt" when in the S configuration), 4'-$CH_2$—O—$CH_2$-2', 4'-$CH_2$—N(R)-2', 4'-$CH(CH_2OCH_3)$—O-2' ("constrained MOE" or "cMOE") and analogs thereof (see, e.g., Seth et al., U.S. Pat. No. 7,399,845, Bhat et al., U.S. Pat. No. 7,569,686, Swayze et al., U.S. Pat. No. 7,741,457, and Swayze et al., U.S. Pat. No. 8,022,193), 4'-$C(CH_3)(CH_3)$—O-2' and analogs thereof (see, e.g., Seth et al., U.S. Pat. No. 8,278,283), 4'-$CH_2$—$N(OCH_3)$-2' and analogs thereof (see, e.g., Prakash et al., U.S. Pat. No. 8,278,425), 4'-$CH_2$—O—$N(CH_3)$-2' (see, e.g., Allerson et al., U.S. Pat. No. 7,696,345 and Allerson et al., U.S. Pat. No. 8,124,745), 4'-$CH_2$—$C(H)(CH_3)$-2' (see, e.g., Zhou, et al., *J Org. Chem.,* 2009, 74, 118-134), 4'-$CH_2$—$C(=CH_2)$-2' and analogs thereof (see e.g., Seth et al., U.S. Pat. No. 8,278,426), 4'-$C(R_aR_b)$—N(R)—O-2', 4'-$C(R_aR_b)$—O—N(R)-2', 4'-$CH_2$—O—N(R)-2', and 4'-$CH_2$—N(R)—O-2', wherein each R, $R_a$, and $R_b$ is, independently, H, a protecting group, or $C_1$-$C_{12}$ alkyl (see, e.g. Imanishi et al., U.S. Pat. No. 7,427,672).

In certain embodiments, such 4' to 2' bridges independently comprise from 1 to 4 linked groups independently selected from: —$[C(R_a)(R_b)]_n$—, —$[C(R_a)(R_b)]_n$O—, —$C(R_a)$=$C(R_b)$—, —$C(R_a)$=N—, —C(=$NR_a$)—, —C(=O)—, —C(=S)—, —O—, —$Si(R_a)_2$—, —S(=O)—, and —$N(R_a)$—;

wherein:

x is 0, 1, or 2;

n is 1, 2, 3, or 4;

each $R_a$ and $R_b$ is, independently, H, a protecting group, hydroxyl, $C_1$-$C_{12}$ alkyl, substituted $C_1$-$C_{12}$ alkyl, $C_2$-$C_{12}$ alkenyl, substituted $C_2$-$C_{12}$ alkenyl, $C_2$-$C_{12}$ alkynyl, substituted $C_2$-$C_{12}$ alkynyl, $C_5$-$C_{20}$ aryl, substituted $C_5$-$C_{20}$ aryl, heterocycle radical, substituted heterocycle radical, heteroaryl, substituted heteroaryl, $C_5$-$C_7$ alicyclic radical, substituted $C_5$-$C_7$ alicyclic radical, halogen, $OJ_1$, $NJ_1J_2$, $SJ_1$, $N_3$, $COOJ_1$, acyl (C(=O)—H), substituted acyl, CN, sulfonyl $(S(=O)_2$-$J_1)$, or sulfoxyl (S(=O)-$J_1$); and each $J_1$ and $J_2$ is, independently, H, $C_1$-$C_{12}$ alkyl, substituted $C_1$-$C_{12}$ alkyl, $C_2$-$C_{12}$ alkenyl, substituted $C_2$-$C_{12}$ alkenyl, $C_2$-$C_{12}$ alkynyl, substituted $C_2$-$C_{12}$ alkynyl, $C_5$-$C_{20}$ aryl, substituted $C_5$-$C_{20}$ aryl, acyl (C(=O)—H), substituted acyl, a heterocycle radical, a substituted heterocycle radical, $C_1$-$C_{12}$ aminoalkyl, substituted $C_1$-$C_{12}$ aminoalkyl, or a protecting group.

Additional bicyclic sugar moieties are known in the art, see, for example: Freier et al., Nucleic Acids Research, 1997, 25(22), 4429-4443, Albaek et al., J. Org. Chem., 2006, 71, 7731-7740, Singh et al., Chem. Commun., 1998, 4, 455-456; Koshkin et al., Tetrahedron, 1998, 54, 3607-3630; Wahlestedt et al., Proc. Natl. Acad. Sci. U.S.A, 2000, 97, 5633-5638; Kumar et al., Bioorg. Med. Chem. Lett., 1998, 8, 2219-2222; Singh et al., J. Org. Chem., 1998, 63, 10035-10039; Srivastava et al., J. Am. Chem. Soc., 2007, 129, 8362-8379; Elayadi et al., Curr. Opinion Invens. Drugs, 2001, 2, 558-561; Braasch et al., Chem. Biol., 2001, 8, 1-7; Orum et al., Curr. Opinion Mol. Ther., 2001, 3, 239-243; Wengel et al., U.S. Pat. No. 7,053,207, Imanishi et al., U.S. Pat. No. 6,268,490, Imanishi et al. U.S. Pat. No. 6,770,748, Imanishi et al., U.S. Pat. No. RE44,779; Wengel et al., U.S. Pat. No. 6,794,499, Wengel et al., U.S. Pat. No. 6,670,461; Wengel et al., U.S. Pat. No. 7,034,133, Wengel et al., U.S. Pat. No. 8,080,644; Wengel et al., U.S. Pat. No. 8,034,909; Wengel et al., U.S. Pat. No. 8,153,365; Wengel et al., U.S. Pat. No. 7,572,582; and Ramasamy et al., U.S. Pat. No. 6,525,191, Torsten et al., WO 2004/106356, Wengel et al., WO 1999/014226; Seth et al., WO 2007/134181; Seth et al., U.S. Pat. No. 7,547,684; Seth et al., U.S. Pat. No. 7,666,854; Seth et al., U.S. Pat. No. 8,088,746; Seth et al., U.S. Pat. No. 7,750,131; Seth et al., U.S. Pat. No. 8,030,467; Seth et al., U.S. Pat. No. 8,268,980; Seth et al., U.S. Pat. No. 8,546,556; Seth et al., U.S. Pat. No. 8,530,640; Migawa et al., U.S. Pat. No. 9,012,421; Seth et al., U.S. Pat. No. 8,501,805; Allerson et al., US2008/0039618; and Migawa et al., US2015/0191727. In certain embodiments, bicyclic sugar moieties and nucleosides incorporating such bicyclic sugar moieties are further defined by isomeric configuration. For example, an LNA nucleoside (described herein) may be in the a-L configuration or in the β-D configuration.

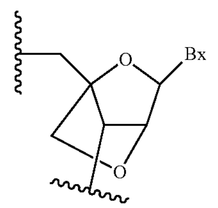

LNA (β-D-configuration)
bridge = 4'-$CH_2$—O-2'

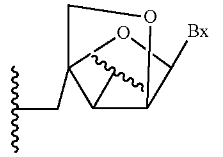

α-L-LNA (α-L-configuration)
bridge = 4'-$CH_2$—O-2'

α-L-methyleneoxy (4'-$CH_2$—O-2') or a-L-LNA bicyclic nucleosides have been incorporated into oligonucleotides that showed antisense activity (Frieden et al., *Nucleic Acids Research,* 2003, 21, 6365-6372). Herein, general descriptions of bicyclic nucleosides include both isomeric configurations. When the positions of specific bicyclic nucleosides (e.g., LNA or cEt) are identified in exemplified embodiments herein, they are in the β-D configuration, unless otherwise specified.

In certain embodiments, modified sugar moieties comprise one or more non-bridging sugar substituent and one or more bridging sugar substituent (e.g., 5'-substituted and 4'-2' bridged sugars).

In certain embodiments, modified sugar moieties are sugar surrogates. In certain such embodiments, the oxygen atom of the sugar moiety is replaced, e.g., with a sulfur, carbon or nitrogen atom. In certain such embodiments, such modified sugar moieties also comprise bridging and/or non-bridging substituents as described herein. For example, certain sugar surrogates comprise a 4'-sulfur atom and a substitution at the 2'-position (see, e.g., Bhat et al., U.S. Pat. No. 7,875,733 and Bhat et al., U.S. Pat. No. 7,939,677) and/or the 5' position.

In certain embodiments, sugar surrogates comprise rings having other than 5 atoms. For example, in certain embodiments, a sugar surrogate comprises a six-membered tetrahydropyran ("THP"). Such tetrahydropyrans may be further modified or substituted. Nucleosides comprising such modified tetrahydropyrans include but are not limited to hexitol nucleic acid ("HNA"), anitol nucleic acid ("ANA"), manitol nucleic acid ("MNA") (see, e.g., Leumann, C J. *Bioorg. & Med. Chem.* 2002, 10, 841-854), fluoro HNA:

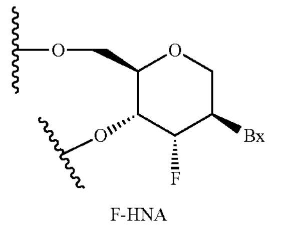

F-HNA ("F-HNA", see e.g. Swayze et al., U.S. Pat. No. 8,088,904; Swayze et al., U.S. Pat. No. 8,440,803; Swayze et al., U.S.

Pat. No. 8,796,437; and Swayze et al., U.S. Pat. No. 9,005,906; F-HNA can also be referred to as a F-THP or 3'-fluoro tetrahydropyran), and nucleosides comprising additional modified THP compounds having the formula:

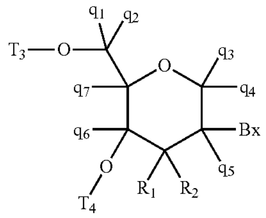

wherein, independently, for each of the modified THP nucleosides:

Bx is a nucleobase moiety;

$T_3$ and $T_4$ are each, independently, an internucleoside linking group linking the modified THP nucleoside to the remainder of an oligonucleotide or one of $T_3$ and $T_4$ is an internucleoside linking group linking the modified THP nucleoside to the remainder of an oligonucleotide and the other of $T_3$ and $T_4$ is H, a hydroxyl protecting group, a linked conjugate group, or a 5' or 3'-terminal group;

$q_1$, $q_2$, $q_3$, $q_4$, $q_5$, $q_6$ and $q_7$ are each, independently, H, $C_1$-$C_6$ alkyl, substituted $C_1$-$C_6$ alkyl, $C_2$-$C_6$ alkenyl, substituted $C_2$-$C_6$ alkenyl, $C_2$-$C_6$ alkynyl, or substituted $C_2$-$C_6$ alkynyl; and each of $R_1$ and $R_2$ is independently selected from among: hydrogen, halogen, substituted or unsubstituted alkoxy, $NJ_1J_2$, $SJ_1$, $N_3$, $OC(=X)J_1$, $OC(=X)NJ_1J_2$, $NJ_3C(=X)NJ_1J_2$, and CN, wherein X is O, S or $NJ_1$, and each $J_1$, $J_2$, and $J_3$ is, independently, H or $C_1$-$C_6$ alkyl.

In certain embodiments, modified THP nucleosides are provided wherein $q_1$, $q_2$, $q_3$, $q_4$, $q_5$, $q_6$ and $q_7$ are each H. In certain embodiments, at least one of $q_1$, $q_2$, $q_3$, $q_4$, $q_5$, $q_6$ and $q_7$ is other than H. In certain embodiments, at least one of $q_1$, $q_2$, $q_3$, $q_4$, $q_5$, $q_6$ and $q_7$ is methyl. In certain embodiments, modified THP nucleosides are provided wherein one of $R_1$ and $R_2$ is F. In certain embodiments, $R_1$ is F and $R_2$ is H, in certain embodiments, $R_1$ is methoxy and $R_2$ is H, and in certain embodiments, $R_1$ is methoxyethoxy and $R_2$ is H.

In certain embodiments, sugar surrogates comprise rings having more than 5 atoms and more than one heteroatom. For example, nucleosides comprising morpholino sugar moieties and their use in oligonucleotides have been reported (see, e.g., Braasch et al., Biochemistry, 2002, 41, 4503-4510 and Summerton et al., U.S. Pat. No. 5,698,685; Summerton et al., U.S. Pat. No. 5,166,315; Summerton et al., U.S. Pat. No. 5,185,444; and Summerton et al., U.S. Pat. No. 5,034,506). As used here, the term "morpholino" means a sugar surrogate having the following structure:

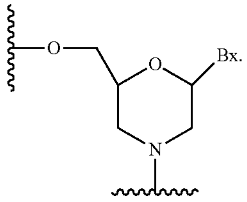

In certain embodiments, morpholinos may be modified, for example by adding or altering various substituent groups from the above morpholino structure. Such sugar surrogates are referred to herein as "modified morpholinos."

In certain embodiments, sugar surrogates comprise acyclic moieties. Examples of nucleosides and oligonucleotides comprising such acyclic sugar surrogates include but are not limited to: peptide nucleic acid ("PNA"), acyclic butyl nucleic acid (see, e.g., Kumar et al., *Org. Biomol. Chem.,* 2013, 11, 5853-5865), and nucleosides and oligonucleotides described in Manoharan et al., WO2011/133876.

Many other bicyclic and tricyclic sugar and sugar surrogate ring systems are known in the art that can be used in modified nucleosides.

2. Certain Modified Nucleobases

In certain embodiments, modified oligonucleotides comprise one or more nucleosides comprising an unmodified nucleobase. In certain embodiments, modified oligonucleotides comprise one or more nucleoside comprising a modified nucleobase. In certain embodiments, modified oligonucleotides comprise one or more nucleoside that does not comprise a nucleobase, referred to as an abasic nucleoside.

In certain embodiments, modified nucleobases are selected from: 5-substituted pyrimidines, 6-azapyrimidines, alkyl or alkynyl substituted pyrimidines, alkyl substituted purines, and N-2, N-6 and 0-6 substituted purines. In certain embodiments, modified nucleobases are selected from: 5-methyl cytosine, 2-aminopropyladenine, 5-hydroxymethyl cytosine, xanthine, hypoxanthine, 2-aminoadenine, 6-N-methylguanine, 6-N-methyladenine, 2-propyladenine, 2-thiouracil, 2-thiothymine and 2-thiocytosine, 5-propynyl ($-C\equiv C-CH_3$) uracil, 5-propynylcytosine, 6-azouracil, 6-azocytosine, 6-azothymine, 5-ribosyluracil (pseudouracil), 4-thiouracil, 8-halo, 8-amino, 8-thiol, 8-thioalkyl, 8-hydroxyl, 8-aza and other 8-substituted purines, 5-halo, particularly 5-bromo, 5-trifluoromethyl, 5-halouracil, and 5-halocytosine, 7-methylguanine, 7-methyladenine, 2-F-adenine, 2-aminoadenine, 7-deazaguanine, 7-deazaadenine, 3-deazaguanine, 3-deazaadenine, 6-N-benzoyladenine, 2-N-isobutyrylguanine, 4-N-benzoylcytosine, 4-N-benzoyluracil, 5-methyl 4-N-benzoylcytosine, 5-methyl 4-N-benzoyluracil, universal bases, hydrophobic bases, promiscuous bases, size-expanded bases, and fluorinated bases. Further modified nucleobases include tricyclic pyrimidines, such as 1,3-diazaphenoxazine-2-one, 1,3-diazaphenothiazine-2-one and 9-(2-aminoethoxy)-1,3-diazaphenoxazine-2-one (G-clamp). Modified nucleobases may also include those in which the purine or pyrimidine base is replaced with other heterocycles, for example 7-deaza-adenine, 7-deazaguanosine, 2-aminopyridine and 2-pyridone. Further nucleobases include those disclosed in Merigan et al., U.S. Pat. No. 3,687,808, those disclosed in *The Concise Encyclopedia Of Polymer Science And Engineering*, Kroschwitz, J. I., Ed., John Wiley & Sons, 1990, 858-859; Englisch et al., *Angewandte Chemie*, International Edition, 1991, 30, 613; Sanghvi, Y. S., Chapter 15, *Antisense Research and Applications*, Crooke, S. T. and Lebleu, B., Eds., CRC Press, 1993, 273-288; and those disclosed in Chapters 6 and 15, Antisense Drug Technology, Crooke S. T., Ed., CRC Press, 2008, 163-166 and 442-443.

Publications that teach the preparation of certain of the above noted modified nucleobases as well as other modified nucleobases include without limitation, Manoharan et al., US2003/0158403; Manoharan et al., US2003/0175906; Dinh et al., U.S. Pat. No. 4,845,205; Spielvogel et al., U.S. Pat. No. 5,130,302; Rogers et al., U.S. Pat. No. 5,134,066; Bischofberger et al., U.S. Pat. No. 5,175,273; Urdea et al., U.S. Pat. No. 5,367,066; Benner et al., U.S. Pat. No. 5,432,272; Matteucci et al., U.S. Pat. No. 5,434,257; Gmeiner et al., U.S. Pat. No. 5,457,187; Cook et al., U.S. Pat. No. 5,459,255; Froehler et al., U.S. Pat. No. 5,484,908; Matteucci et al., U.S. Pat. No. 5,502,177; Hawkins et al., U.S. Pat. No. 5,525,711; Haralambidis et al., U.S. Pat. No. 5,552,540; Cook et al., U.S. Pat. No. 5,587,469; Froehler et al., U.S. Pat. No. 5,594,121; Switzer et al., U.S. Pat. No. 5,596,091; Cook et al., U.S. Pat. No. 5,614,617; Froehler et al., U.S. Pat. No. 5,645,985; Cook et al., U.S. Pat. No. 5,681,941; Cook et al., U.S. Pat. No. 5,811,534; Cook et al., U.S. Pat. No. 5,750,692; Cook et al., U.S. Pat. No. 5,948,903; Cook et al., U.S. Pat. No. 5,587,470; Cook et al., U.S. Pat. No. 5,457,191; Matteucci et al., U.S. Pat. No. 5,763,588; Froehler et al., U.S. Pat. No. 5,830,653; Cook et al., U.S. Pat. No. 5,808,027; Cook et al., 6,166,199; and Matteucci et al., U.S. Pat. No. 6,005,096.

3. Certain Modified Internucleoside Linkages

In certain embodiments, nucleosides of modified oligonucleotides may be linked together using any internucleoside linkage. The two main classes of internucleoside linking groups are defined by the presence or absence of a phosphorus atom. Representative phosphorus-containing internucleoside linkages include but are not limited to phosphodiesters, which contain a phosphodiester bond ("$P(O_2)=O$") (also referred to as unmodified or naturally occurring linkages), phosphotriesters, methylphosphonates, phosphoramidates, phosphorothioates ("$P(O_2)=S$"), and phosphorodithioates ("HS-P=S"). Representative non-phosphorus containing internucleoside linking groups include but are not limited to methylenemethylimino ($-CH_2-N(CH_3)-O-CH_2-$), thiodiester, thionocarbamate ($-O-C(=O)(NH)-S-$); siloxane ($-O-SiH_2-O-$); and N,N'-dimethylhydrazine ($-CH_2-N(CH_3)-N(CH_3)-$). Modified internucleoside linkages, compared to naturally occurring phosphodiester internucleoside linkages, can be used to alter, typically increase, nuclease resistance of the oligonucleotide. In certain embodiments, internucleoside linkages having a chiral atom can be prepared as a racemic mixture, or as separate enantiomers. Methods of preparation of phosphorous-containing and non-phosphorous-containing internucleoside linkages are well known to those skilled in the art.

Representative internucleoside linkages having a chiral center include but are not limited to alkylphosphonates and phosphorothioates. Modified oligonucleotides comprising internucleoside linkages having a chiral center can be prepared as populations of modified oligonucleotides comprising stereorandom internucleoside linkages, or as populations of modified oligonucleotides comprising phosphorothioate internucleoside linkages in particular stereochemical configurations. In certain embodiments, populations of modified oligonucleotides comprise phosphorothioate internucleoside linkages wherein all of the phosphorothioate internucleoside linkages are stereorandom. Such modified oligonucleotides can be generated using synthetic methods that result in random selection of the stereochemical configuration of each phosphorothioate internucleoside linkage. Nonetheless, as is well understood by those of skill in the art, each individual phosphorothioate of each individual oligonucleotide molecule has a defined stereoconfiguration. In certain embodiments, populations of modified oligonucleotides are enriched for modified oligonucleotides comprising one or more particular phosphorothioate internucleoside linkage in a particular, independently selected stereochemical configuration. In certain embodiments, the particular configuration of the particular phosphorothioate internucleoside linkage is present in at least 65% of the molecules in the population. In certain embodiments, the particular configuration of the particular phosphorothioate internucleoside linkage is present in at least 70% of the molecules in the population. In certain embodiments, the particular configuration of the particular phosphorothioate internucleoside linkage is present in at least 80% of the molecules in the population. In certain embodiments, the particular configuration of the particular phosphorothioate internucleoside linkage is present in at least 90% of the molecules in the population. In certain embodiments, the particular configuration of the particular phosphorothioate internucleoside linkage is present in at least 99% of the molecules in the population. Such chirally enriched populations of modified oligonucleotides can be generated using synthetic methods known in the art, e.g., methods described in Oka et al., *JACS,* 2003, 125, 8307, Wan et al., *Nuc. Acid. Res.,* 2014, 42, 13456, and WO 2017/015555. In certain embodiments, a population of modified oligonucleotides is enriched for modified oligonucleotides having at least one indicated phosphorothioate in the (Sp) configuration. In certain embodiments, a population of modified oligonucleotides is enriched for modified oligonucleotides having at least one phosphorothioate in the (Rp) configuration. In certain embodiments, modified oligonucleotides comprising (Rp) and/or (Sp) phosphorothioates comprise one or more of the following formulas, respectively, wherein "B" indicates a nucleobase:

($R_p$)

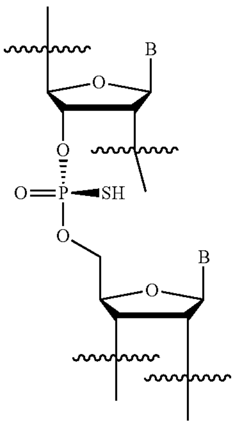

($S_p$)

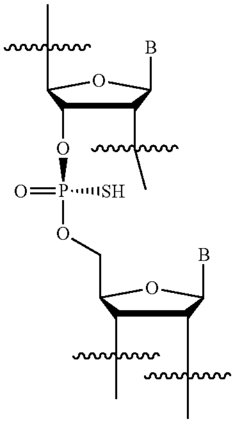

Unless otherwise indicated, chiral internucleoside linkages of modified oligonucleotides described herein can be stereorandom or in a particular stereochemical configuration.

Neutral internucleoside linkages include, without limitation, phosphotriesters, methylphosphonates, MMI (3'-$CH_2$—N($CH_3$)—O-5'), amide-3 (3'-$CH_2$—C(=O)—N(H)-5'), amide-4 (3'-$CH_2$—N(H)-C(=O)-5'), formacetal (3'-O—$CH_2$—O-5'), methoxypropyl (MOP), and thioformacetal (3'-S—$CH_2$—O-5'). Further neutral internucleoside linkages include nonionic linkages comprising siloxane (dialkylsiloxane), carboxylate ester, carboxamide, sulfide, sulfonate ester and amides (see, for example: *Carbohydrate Modifications in Antisense Research*; Y. S. Sanghvi and P. D. Cook, Eds., ACS Symposium Series 580; Chapters 3 and 4, 40-65). Further neutral internucleoside linkages include nonionic linkages comprising mixed N, O, S and $CH_2$ component parts.

B. Certain Motifs

In certain embodiments, modified oligonucleotides comprise one or more modified nucleosides comprising a modified sugar moiety. In certain embodiments, modified oligonucleotides comprise one or more modified nucleosides comprising a modified nucleobase. In certain embodiments, modified oligonucleotides comprise one or more modified internucleoside linkage. In such embodiments, the modified, unmodified, and differently modified sugar moieties, nucleobases, and/or internucleoside linkages of a modified oligonucleotide define a pattern or motif. In certain embodiments, the patterns of sugar moieties, nucleobases, and internucleoside linkages are each independent of one another. Thus, a modified oligonucleotide may be described by its sugar motif, nucleobase motif and/or internucleoside linkage motif (as used herein, nucleobase motif describes the modifications to the nucleobases independent of the sequence of nucleobases).

1. Certain Sugar Motifs

In certain embodiments, oligonucleotides comprise one or more type of modified sugar and/or unmodified sugar moiety arranged along the oligonucleotide or portion thereof in a defined pattern or sugar motif. In certain instances, such sugar motifs include but are not limited to any of the sugar modifications discussed herein.

In certain embodiments, modified oligonucleotides have a gapmer motif, which is defined by two external regions or "wings" and a central or internal region or "gap." The three regions of a gapmer motif (the 5'-wing, the gap, and the 3'-wing) form a contiguous sequence of nucleosides wherein at least some of the sugar moieties of the nucleosides of each of the wings differ from at least some of the sugar moieties of the nucleosides of the gap. Specifically, at least the sugar moieties of the nucleosides of each wing that are closest to the gap (the 3'-most nucleoside of the 5'-wing and the 5'-most nucleoside of the 3'-wing) differ from the sugar moiety of the neighboring gap nucleosides, thus defining the boundary between the wings and the gap (i.e., the wing/gap junction). In certain embodiments, the sugar moieties within the gap are the same as one another. In certain embodiments, the gap includes one or more nucleoside having a sugar moiety that differs from the sugar moiety of one or more other nucleosides of the gap. In certain embodiments, the sugar motifs of the two wings are the same as one another (symmetric gapmer). In certain embodiments, the sugar motif of the 5'-wing differs from the sugar motif of the 3'-wing (asymmetric gapmer).

In certain embodiments, the wings of a gapmer comprise 1-6 nucleosides. In certain embodiments, each nucleoside of each wing of a gapmer comprises a modified sugar moiety. In certain embodiments, at least one nucleoside of each wing of a gapmer comprises a modified sugar moiety. In certain embodiments, at least two nucleosides of each wing of a gapmer comprises a modified sugar moiety. In certain embodiments, at least three nucleosides of each wing of a gapmer comprises a modified sugar moiety. In certain embodiments, at least four nucleosides of each wing of a gapmer comprises a modified sugar moiety. In certain embodiments, at least five nucleosides of each wing of a gapmer comprises a modified sugar moiety.

In certain embodiments, the gap of a gapmer comprises 7-12 nucleosides. In certain embodiments, each nucleoside of the gap of a gapmer comprises a 2'-deoxyribosyl sugar moiety. In certain embodiments, at least six nucleosides of the gap of a gapmer comprise a 2'-β-D-deoxyribosyl sugar moiety. In certain embodiments, each nucleoside of the gap of a gapmer comprises a 2'-β-D-deoxyribosyl sugar moiety. In certain embodiments, at least one nucleoside of the gap of a gapmer comprises a modified sugar moiety. In certain embodiments, at least one nucleoside of the gap of a gapmer comprises a 2'-OMe sugar moiety.

In certain embodiments, the gapmer is a deoxy gapmer. In certain embodiments, the nucleosides on the gap side of each wing/gap junction comprise 2'-deoxyribosyl sugar moieties and the nucleosides on the wing sides of each wing/gap junction comprise modified sugar moieties. In certain embodiments, at least six nucleosides of the gap of a gapmer comprise a 2'-β-D-deoxyribosyl sugar moiety. In certain embodiments, each nucleoside of the gap of a gapmer comprises a 2'-deoxyribosyl sugar moiety. In certain embodiments, each nucleoside of each wing of a gapmer comprises a modified sugar moiety. In certain embodiments, one nucleoside of the gap comprises a modified sugar moiety and each remaining nucleoside of the gap comprises a 2'-deoxyribosyl sugar moiety.

In certain embodiments, modified oligonucleotides comprise or consist of a portion having a fully modified sugar motif. In such embodiments, each nucleoside of the fully modified portion of the modified oligonucleotide comprises a modified sugar moiety. In certain embodiments, each nucleoside of the entire modified oligonucleotide comprises a modified sugar moiety. In certain embodiments, modified oligonucleotides comprise or consist of a portion having a fully modified sugar motif, wherein each nucleoside within the fully modified portion comprises the same modified sugar moiety, referred to herein as a uniformly modified sugar motif. In certain embodiments, a fully modified oligonucleotide is a uniformly modified oligonucleotide. In certain embodiments, each nucleoside of a uniformly modified oligonucleotide comprises the same 2'-modification.

Herein, the lengths (number of nucleosides) of the three regions of a gapmer may be provided using the notation [# of nucleosides in the 5'-wing]–[# of nucleosides in the gap]–[# of nucleosides in the 3'-wing]. Thus, a 5-10-5 gapmer consists of 5 linked nucleosides in each wing and 10 linked nucleosides in the gap. Where such nomenclature is followed by a specific modification, that modification is the modification in each sugar moiety of each wing and the gap nucleosides comprises a 2'-β-D-deoxyribosyl sugar moiety. Thus, a 5-10-5 MOE gapmer consists of 5 linked 2'-MOE nucleosides in the 5'-wing, 10 linked 2'-β-D-deoxynucleosides in the gap, and 5 linked 2'-MOE nucleosides in the 3'-wing. A 3-10-3 cEt gapmer consists of 3 linked cEt nucleosides in the 5'-wing, 10 linked 2'-β-D-deoxynucleosides in the gap, and 3 linked cEt nucleosides in the 3'-wing. A 5-8-5 gapmer consists of 5 linked nucleosides comprising a modified sugar moiety in the 5'-wing, 8 linked a 2'-β-D-deoxynucleosides in the gap, and 5 linked nucleosides comprising a modified sugar moiety in the 3'-wing. A mixed wing gapmer has at least two different modified sugar moieties in the 5' and/or the 3' wing. A 5-8-5 or 5-8-4 mixed wing gapmer has at least two different modified sugar moieties in the 5'- and/or the 3'-wing.

In certain embodiments, modified oligonucleotides are 5-10-5 MOE gapmers. In certain embodiments, modified oligonucleotides are 6-10-4 MOE gapmers. In certain embodiments, modified oligonucleotides are 4-10-6 MOE gapmers. In certain embodiments, modified oligonucleotides are 4-8-6 MOE gapmers. In certain embodiments, modified oligonucleotides are 6-8-4 MOE gapmers. In certain embodiments, modified oligonucleotides are 5-8-4 MOE gapmers. In certain embodiments, modified oligonucleotides are 3-10-7 MOE gapmers. In certain embodiments, modified oligonucleotides are 7-10-3 MOE gapmers. In certain embodiments, modified oligonucleotides are 5-8-5 MOE gapmers. In certain embodiments, modified oligonucleotides are 5-9-5 MOE gapmers. In certain embodiments, modified oligonucleotides are X—Y—Z MOE gapmers, wherein X and Z are independently selected from 1, 2, 3, 4, 5, 6, or 7 linked 2'-MOE nucleosides and Y is selected from 7, 8, 9, 10, or 11 linked deoxynucleosides.

In certain embodiments, modified oligonucleotides have the following sugar motif (5' to 3'): eeeeeddddddddddeeeee, eeeeeeddddddddddeeee, or eeeeedyddddddddeeeee, wherein 'd' represents a 2'-deoxyribosyl sugar moiety, 'e' represents a 2'-MOE sugar moiety, and 'y' represents a 2'-OMe sugar moiety.

2. Certain Nucleobase Motifs

In certain embodiments, oligonucleotides comprise modified and/or unmodified nucleobases arranged along the oligonucleotide or portion thereof in a defined pattern or motif. In certain embodiments, each nucleobase is modified.

In certain embodiments, none of the nucleobases are modified. In certain embodiments, each purine or each pyrimidine is modified. In certain embodiments, each adenine is modified. In certain embodiments, each guanine is modified. In certain embodiments, each thymine is modified. In certain embodiments, each uracil is modified. In certain embodiments, each cytosine is modified. In certain embodiments, some or all of the cytosine nucleobases in a modified oligonucleotide are 5-methyl cytosines. In certain embodiments, all of the cytosine nucleobases are 5-methyl cytosines and all of the other nucleobases of the modified oligonucleotide are unmodified nucleobases.

In certain embodiments, modified oligonucleotides comprise a block of modified nucleobases. In certain such embodiments, the block is at the 3'-end of the oligonucleotide. In certain embodiments the block is within 3 nucleosides of the 3'-end of the oligonucleotide. In certain embodiments, the block is at the 5'-end of the oligonucleotide. In certain embodiments the block is within 3 nucleosides of the 5'-end of the oligonucleotide.

In certain embodiments, oligonucleotides having a gapmer motif comprise a nucleoside comprising a modified nucleobase. In certain such embodiments, one nucleoside comprising a modified nucleobase is in the central gap of an oligonucleotide having a gapmer motif. In certain such embodiments, the sugar moiety of the nucleoside is a 2'-deoxyribosyl sugar moiety. In certain embodiments, the modified nucleobase is selected from: a 2-thiopyrimidine and a 5-propynepyrimidine.

3. Certain Internucleoside Linkage Motifs

In certain embodiments, oligonucleotides comprise modified and/or unmodified internucleoside linkages arranged along the oligonucleotide or portion thereof in a defined pattern or motif. In certain embodiments, each internucleoside linking group is a phosphodiester internucleoside linkage (P═O). In certain embodiments, each internucleoside linking group of a modified oligonucleotide is a phosphorothioate internucleoside linkage (P═S). In certain embodiments, each internucleoside linkage of a modified oligonucleotide is independently selected from a phosphorothioate internucleoside linkage and phosphodiester internucleoside linkage. In certain embodiments, each phosphorothioate internucleoside linkage is independently selected from a stereorandom phosphorothioate, a (Sp) phosphorothioate, and a (Rp) phosphorothioate. In certain embodiments, the sugar motif of a modified oligonucleotide is a gapmer and the internucleoside linkages within the gap are all modified. In certain such embodiments, some or all of the internucleoside linkages in the wings are unmodified phosphodiester internucleoside linkages. In certain embodiments, the terminal internucleoside linkages are modified. In certain embodiments, the sugar motif of a modified oligonucleotide is a gapmer, and the internucleoside linkage motif comprises at least one phosphodiester internucleoside linkage in at least one wing, wherein the at least one phosphodiester internucleoside linkage is not a terminal internucleoside linkage, and the remaining internucleoside linkages are phosphorothioate internucleoside linkages. In certain such embodiments, all of the phosphorothioate internucleoside linkages are stereorandom. In certain embodiments, all of the phosphorothioate internucleoside linkages in the wings are (Sp) phosphorothioates, and the gap comprises at least one Sp, Sp, Rp motif. In certain embodiments, populations of modified oligonucleotides are enriched for modified oligonucleotides comprising such internucleoside linkage motifs.

In certain embodiments, modified oligonucleotides have an internucleoside linkage motif of sooosssssssssssooss or sooooosssssssssssoss wherein each "s" represents a phosphorothioate internucleoside linkage and each "o" represents a phosphodiester internucleoside linkage.

C. Certain Lengths

It is possible to increase or decrease the length of an oligonucleotide without eliminating activity. For example, in Woolf et al., *Proc. Natl. Acad. Sci. USA,* 1992, 89, 7305-7309, 1992), a series of oligonucleotides 13-25 nucleobases in length were tested for their ability to induce cleavage of a target nucleic acid in an oocyte injection model. Oligonucleotides 25 nucleobases in length with 8 or 11 mismatch bases near the ends of the oligonucleotides were able to direct specific cleavage of the target nucleic acid, albeit to a lesser extent than the oligonucleotides that contained no mismatches. Similarly, target specific cleavage was achieved using 13 nucleobase oligonucleotides, including those with 1 or 3 mismatches.

In certain embodiments, oligonucleotides (including modified oligonucleotides) can have any of a variety of ranges of lengths. In certain embodiments, oligonucleotides consist of X to Y linked nucleosides, where X represents the fewest number of nucleosides in the range and Y represents the largest number nucleosides in the range. In certain such embodiments, X and Y are each independently selected from 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, and 50; provided that X≤Y. For example, in certain embodiments, oligonucleotides consist of 12 to 13, 12 to 14, 12 to 15, 12 to 16, 12 to 17, 12 to 18, 12 to 19, 12 to 20, 12 to 21, 12 to 22, 12 to 23, 12 to 24, 12 to 25, 12 to 26, 12 to 27, 12 to 28, 12 to 29, 12 to 30, 13 to 14, 13 to 15, 13 to 16, 13 to 17, 13 to 18, 13 to 19, 13 to 20, 13 to 21, 13 to 22, 13 to 23, 13 to 24, 13 to 25, 13 to 26, 13 to 27, 13 to 28, 13 to 29, 13 to 30, 14 to 15, 14 to 16, 14 to 17, 14 to 18, 14 to 19, 14 to 20, 14 to 21, 14 to 22, 14 to 23, 14 to 24, 14 to 25, 14 to 26, 14 to 27, 14 to 28, 14 to 29, 14 to 30, 15 to 16, 15 to 17, 15 to 18, 15 to 19, 15 to 20, 15 to 21, 15 to 22, 15 to 23, 15 to 24, 15 to 25, 15 to 26, 15 to 27, 15 to 28, 15 to 29, 15 to 30, 16 to 17, 16 to 18, 16 to 19, 16 to 20, 16 to 21, 16 to 22, 16 to 23, 16 to 24, 16 to 25, 16 to 26, 16 to 27, 16 to 28, 16 to 29, 16 to 30, 17 to 18, 17 to 19, 17 to 20, 17 to 21, 17 to 22, 17 to 23, 17 to 24, 17 to 25, 17 to 26, 17 to 27, 17 to 28, 17 to 29, 17 to 30, 18 to 19, 18 to 20, 18 to 21, 18 to 22, 18 to 23, 18 to 24, 18 to 25, 18 to 26, 18 to 27, 18 to 28, 18 to 29, 18 to 30, 19 to 20, 19 to 21, 19 to 22, 19 to 23, 19 to 24, 19 to 25, 19 to 26, 19 to 29, 19 to 28, 19 to 29, 19 to 30, 20 to 21, 20 to 22, 20 to 23, 20 to 24, 20 to 25, 20 to 26, 20 to 27, 20 to 28, 20 to 29, 20 to 30, 21 to 22, 21 to 23, 21 to 24, 21 to 25, 21 to 26, 21 to 27, 21 to 28, 21 to 29, 21 to 30, 22 to 23, 22 to 24, 22 to 25, 22 to 26, 22 to 27, 22 to 28, 22 to 29, 22 to 30, 23 to 24, 23 to 25, 23 to 26, 23 to 27, 23 to 28, 23 to 29, 23 to 30, 24 to 25, 24 to 26, 24 to 27, 24 to 28, 24 to 29, 24 to 30, 25 to 26, 25 to 27, 25 to 28, 25 to 29, 25 to 30, 26 to 27, 26 to 28, 26 to 29, 26 to 30, 27 to 28, 27 to 29, 27 to 30, 28 to 29, 28 to 30, or 29 to 30 linked nucleosides.

In certain embodiments, oligonucleotides consist of 16 linked nucleosides. In certain embodiments, oligonucleotides consist of 17 linked nucleosides. In certain embodiments, oligonucleotides consist of 18 linked nucleosides. In certain embodiments, oligonucleotides consist of 19 linked nucleosides. In certain embodiments, oligonucleotides consist of 20 linked nucleosides.

D. Certain Modified Oligonucleotides

In certain embodiments, the above modifications (sugar, nucleobase, internucleoside linkage) are incorporated into a modified oligonucleotide. In certain embodiments, modified oligonucleotides are characterized by their modification motifs and overall lengths. In certain embodiments, such parameters are each independent of one another. Thus, unless otherwise indicated, each internucleoside linkage of an oligonucleotide having a gapmer sugar motif may be modified or unmodified and may or may not follow the gapmer modification pattern of the sugar modifications. For example, the internucleoside linkages within the wing regions of a sugar gapmer may be the same or different from one another and may be the same or different from the internucleoside linkages of the gap region of the sugar motif. Likewise, such sugar gapmer oligonucleotides may comprise one or more modified nucleobase independent of the gapmer pattern of the sugar modifications. Unless otherwise indicated, all modifications are independent of nucleobase sequence.

E. Certain Populations of Modified Oligonucleotides

Populations of modified oligonucleotides in which all of the modified oligonucleotides of the population have the same molecular formula can be stereorandom populations or chirally enriched populations. All of the chiral centers of all of the modified oligonucleotides are stereorandom in a stereorandom population. In a chirally enriched population, at least one particular chiral center is not stereorandom in the modified oligonucleotides of the population. In certain embodiments, the modified oligonucleotides of a chirally enriched population are enriched for β-D ribosyl sugar moieties, and all of the phosphorothioate internucleoside linkages are stereorandom. In certain embodiments, the modified oligonucleotides of a chirally enriched population are enriched for both β-D ribosyl sugar moieties and at least one, particular phosphorothioate internucleoside linkage in a particular stereochemical configuration.

F. Nucleobase Sequence

In certain embodiments, oligonucleotides (unmodified or modified oligonucleotides) are further described by their nucleobase sequence. In certain embodiments oligonucleotides have a nucleobase sequence that is complementary to a second oligonucleotide or an identified reference nucleic acid, such as a target nucleic acid. In certain such embodiments, a portion of an oligonucleotide has a nucleobase sequence that is complementary to a second oligonucleotide or an identified reference nucleic acid, such as a target nucleic acid. In certain embodiments, the nucleobase sequence of a portion or entire length of an oligonucleotide is at least 50%, at least 60%, at least 70%, at least 80%, at least 85%, at least 90%, at least 95%, or 100% complementary to the second oligonucleotide or nucleic acid, such as a target nucleic acid.

I. Certain Oligomeric Compounds

In certain embodiments, provided herein are oligomeric compounds, which consist of an oligonucleotide (modified or unmodified) and optionally one or more conjugate groups and/or terminal groups. Conjugate groups consist of one or more conjugate moiety and a conjugate linker which links the conjugate moiety to the oligonucleotide. Conjugate groups may be attached to either or both ends of an oligonucleotide and/or at any internal position. In certain embodiments, conjugate groups are attached to the 2'-position of a nucleoside of a modified oligonucleotide. In certain embodiments, conjugate groups that are attached to either or both ends of an oligonucleotide are terminal groups. In certain such embodiments, conjugate groups or terminal groups are attached at the 3' and/or 5'-end of oligonucleotides. In certain such embodiments, conjugate groups (or terminal groups) are attached at the 3'-end of oligonucleotides. In certain embodiments, conjugate groups are attached near the 3'-end of oligonucleotides. In certain embodiments, conjugate groups (or terminal groups) are attached at the 5'-end of oligonucleotides. In certain embodiments, conjugate groups are attached near the 5'-end of oligonucleotides.

Examples of terminal groups include but are not limited to conjugate groups, capping groups, phosphate moieties, protecting groups, abasic nucleosides, modified or unmodified nucleosides, and two or more nucleosides that are independently modified or unmodified.

A. Certain Conjugate Groups

In certain embodiments, oligonucleotides are covalently attached to one or more conjugate groups. In certain embodiments, conjugate groups modify one or more properties of the attached oligonucleotide, including but not limited to pharmacodynamics, pharmacokinetics, stability, binding, absorption, tissue distribution, cellular distribution, cellular uptake, charge and clearance. In certain embodiments, conjugate groups impart a new property on the attached oligonucleotide, e.g., fluorophores or reporter groups that enable detection of the oligonucleotide. Certain conjugate groups and conjugate moieties have been described previously, for example: cholesterol moiety (Letsinger et al., *Proc. Natl. Acad. Sci. USA,* 1989, 86, 6553-6556), cholic acid (Manoharan et al., *Bioorg. Med. Chem. Lett.,* 1994, 4, 1053-1060), a thioether, e.g., hexyl-S-tritylthiol (Manoharan et al., *Ann. N. Y. Acad. Sci.,* 1992, 660, 306-309; Manoharan et al., *Bioorg. Med. Chem. Lett.,* 1993, 3, 2765-2770), a thiocholesterol (Oberhauser et al., *Nucl. Acids Res.,* 1992, 20, 533-538), an aliphatic chain, e.g., do-decan-diol or undecyl residues (Saison-Behmoaras et al., *EMBO J.,* 1991, 10, 1111-1118; Kabanov et al., *FEBS Lett.,* 1990, 259, 327-330; Svinarchuk et al., *Biochimie,* 1993, 75, 49-54), a phospholipid, e.g., di-hexadecyl-rac-glycerol or triethyl-ammonium 1,2-di-O-hexadecyl-rac-glycero-3-H-phosphonate (Manoharan et al., *Tetrahedron Lett.*, 1995, 36, 3651-3654; Shea et al., *Nucl. Acids Res.*, 1990, 18, 3777-3783), a polyamine or a polyethylene glycol chain (Manoharan et al., *Nucleosides & Nucleotides*, 1995, 14, 969-973), or adamantane acetic acid a palmityl moiety (Mishra et al., *Biochim. Biophys. Acta*, 1995, 1264, 229-237), an octadecylamine or hexylamino-carbonyl-oxycholesterol moiety (Crooke et al., *J. Pharmacol. Exp. Ther.*, 1996, 277, 923-937), a tocopherol group (Nishina et al., *Molecular Therapy Nucleic Acids*, 2015, 4, e220; and Nishina et al., *Molecular Therapy*, 2008, 16, 734-740), or a N-acetylgalactosamine (GalNAc) cluster (e.g., WO2014/179620).

In certain embodiments, conjugate groups may be selected from any of a C22 alkyl, C20 alkyl, C16 alkyl, C10 alkyl, C21 alkyl, C19 alkyl, C18 alkyl, C15 alkyl, C14 alkyl, C13 alkyl, C12 alkyl, C11 alkyl, C9 alkyl, C8 alkyl, C7 alkyl, C6 alkyl, C5 alkyl, C22 alkenyl, C20 alkenyl, C16 alkenyl, C10 alkenyl, C21 alkenyl, C19 alkenyl, C18 alkenyl, C15 alkenyl, C14 alkenyl, C13 alkenyl, C12 alkenyl, C11 alkenyl, C9 alkenyl, C8 alkenyl, C7 alkenyl, C6 alkenyl, or C5 alkenyl.

In certain embodiments, conjugate groups may be selected from any of C22 alkyl, C20 alkyl, C16 alkyl, C10 alkyl, C21 alkyl, C19 alkyl, C18 alkyl, C15 alkyl, C14 alkyl, C13 alkyl, C12 alkyl, C11 alkyl, C9 alkyl, C8 alkyl, C7 alkyl, C6 alkyl, and C5 alkyl, where the alkyl chain has one or more unsaturated bonds.

1. Conjugate Moieties

Conjugate moieties include, without limitation, intercalators, reporter molecules, polyamines, polyamides, peptides, carbohydrates, vitamin moieties, polyethylene glycols, thioethers, polyethers, cholesterols, thiocholesterols, cholic acid moieties, folate, lipids, lipophilic groups, phospholipids, biotin, phenazine, phenanthridine, anthraquinone, adamantane, acridine, fluoresceins, rhodamines, coumarins, fluorophores, and dyes.

In certain embodiments, a conjugate moiety comprises an active drug substance, for example, aspirin, warfarin, phenylbutazone, ibuprofen, suprofen, fen-bufen, ketoprofen, (S)-(+)-pranoprofen, carprofen, dansylsarcosine, 2,3,5-triiodobenzoic acid, fingolimod, flufenamic acid, folinic acid, a benzothiadiazide, chlorothiazide, a diazepine, indomethicin, a barbiturate, a cephalosporin, a sulfa drug, an antidiabetic, an antibacterial or an antibiotic.

2. Conjugate Linkers

Conjugate moieties are attached to oligonucleotides through conjugate linkers. In certain oligomeric compounds, the conjugate linker is a single chemical bond (i.e., the conjugate moiety is attached directly to an oligonucleotide through a single bond). In certain oligomeric compounds, a conjugate moiety is attached to an oligonucleotide via a more complex conjugate linker comprising one or more conjugate linker moieties, which are sub-units making up a conjugate linker. In certain embodiments, the conjugate linker comprises a chain structure, such as a hydrocarbyl chain, or an oligomer of repeating units such as ethylene glycol, nucleosides, or amino acid units.

In certain embodiments, a conjugate linker comprises one or more groups selected from alkyl, amino, oxo, amide, disulfide, polyethylene glycol, ether, thioether, and hydroxylamino. In certain such embodiments, the conjugate linker comprises groups selected from alkyl, amino, oxo, amide and ether groups. In certain embodiments, the conjugate linker comprises groups selected from alkyl and amide groups. In certain embodiments, the conjugate linker comprises groups selected from alkyl and ether groups. In certain embodiments, the conjugate linker comprises at least one phosphorus moiety. In certain embodiments, the conjugate linker comprises at least one phosphate group. In certain embodiments, the conjugate linker includes at least one neutral linking group.

In certain embodiments, conjugate linkers, including the conjugate linkers described above, are bifunctional linking moieties, e.g., those known in the art to be useful for attaching conjugate groups to parent compounds, such as the oligonucleotides provided herein. In general, a bifunctional linking moiety comprises at least two functional groups. One of the functional groups is selected to bind to a particular site on a parent compound and the other is selected to bind to a conjugate group. Examples of functional groups used in a bifunctional linking moiety include but are not limited to electrophiles for reacting with nucleophilic groups and nucleophiles for reacting with electrophilic groups. In certain embodiments, bifunctional linking moieties comprise one or more groups selected from amino, hydroxyl, carboxylic acid, thiol, alkyl, alkenyl, and alkynyl.

Examples of conjugate linkers include but are not limited to pyrrolidine, 8-amino-3,6-dioxaoctanoic acid (ADO), succinimidyl 4-(N-maleimidomethyl) cyclohexane-1-carboxylate (SMCC) and 6-aminohexanoic acid (AHEX or AHA). Other conjugate linkers include but are not limited to substituted or unsubstituted $C_1$-$C_{10}$ alkyl, substituted or unsubstituted $C_2$-$C_{10}$ alkenyl or substituted or unsubstituted $C_2$-$C_{10}$ alkynyl, wherein a nonlimiting list of preferred substituent groups includes hydroxyl, amino, alkoxy, carboxy, benzyl, phenyl, nitro, thiol, thioalkoxy, halogen, alkyl, aryl, alkenyl and alkynyl.

In certain embodiments, conjugate linkers comprise 1-10 linker-nucleosides. In certain embodiments, conjugate linkers comprise 2-5 linker-nucleosides. In certain embodiments, conjugate linkers comprise exactly 3 linker-nucleosides. In certain embodiments, conjugate linkers comprise the TCA motif. In certain embodiments, such linker-nucleosides are modified nucleosides. In certain embodiments such linker-nucleosides comprise a modified sugar moiety. In certain embodiments, linker-nucleosides are unmodified. In certain embodiments, linker-nucleosides comprise an optionally protected heterocyclic base selected from a purine, substituted purine, pyrimidine or substituted pyrimidine. In certain embodiments, a cleavable moiety is a nucleoside selected from uracil, thymine, cytosine, 4-N-benzoylcytosine, 5-methyl cytosine, 4-N-benzoyl-5-methyl cytosine, adenine, 6-N-benzoyladenine, guanine and 2-N-isobutyrylguanine. It is typically desirable for linker-nucleosides to be cleaved from the oligomeric compound after it reaches a target tissue. Accordingly, linker-nucleosides are typically linked to one another and to the remainder of the oligomeric compound through cleavable bonds. In certain embodiments, such cleavable bonds are phosphodiester bonds.

Herein, linker-nucleosides are not considered to be part of the oligonucleotide. Accordingly, in embodiments in which an oligomeric compound comprises an oligonucleotide consisting of a specified number or range of linked nucleosides and/or a specified percent complementarity to a reference nucleic acid and the oligomeric compound also comprises a conjugate group comprising a conjugate linker comprising linker-nucleosides, those linker-nucleosides are not counted toward the length of the oligonucleotide and are not used in determining the percent complementarity of the oligonucleotide for the reference nucleic acid. For example, an oligomeric compound may comprise (1) a modified oligonucleotide consisting of 8-30 nucleosides and (2) a conjugate group comprising 1-10 linker-nucleosides that are contiguous with the nucleosides of the modified oligonucleotide. The total number of contiguous linked nucleosides in such an oligomeric compound is more than 30. Alternatively, an oligomeric compound may comprise a modified oligonucleotide consisting of 8-30 nucleosides and no conjugate group. The total number of contiguous linked nucleosides in such an oligomeric compound is no more than 30. Unless otherwise indicated conjugate linkers comprise no more than 10 linker-nucleosides. In certain embodiments, conjugate linkers comprise no more than 5 linker-nucleosides. In certain embodiments, conjugate linkers comprise no more than 3 linker-nucleosides. In certain embodiments, conjugate linkers comprise no more than 2 linker-nucleosides. In certain embodiments, conjugate linkers comprise no more than 1 linker-nucleoside.

In certain embodiments, it is desirable for a conjugate group to be cleaved from the oligonucleotide. For example, in certain circumstances oligomeric compounds comprising a particular conjugate moiety are better taken up by a particular cell type, but once the oligomeric compound has been taken up, it is desirable that the conjugate group be cleaved to release the unconjugated or parent oligonucleotide. Thus, certain conjugate linkers may comprise one or more cleavable moieties. In certain embodiments, a cleavable moiety is a cleavable bond. In certain embodiments, a cleavable moiety is a group of atoms comprising at least one cleavable bond. In certain embodiments, a cleavable moiety comprises a group of atoms having one, two, three, four, or more than four cleavable bonds. In certain embodiments, a cleavable moiety is selectively cleaved inside a cell or subcellular compartment, such as a lysosome. In certain embodiments, a cleavable moiety is selectively cleaved by endogenous enzymes, such as nucleases.

In certain embodiments, a cleavable bond is selected from among: an amide, an ester, an ether, one or both esters of a phosphodiester, a phosphate ester, a carbamate, or a disulfide. In certain embodiments, a cleavable bond is one or both of the esters of a phosphodiester. In certain embodiments, a cleavable moiety comprises a phosphate or phosphodiester. In certain embodiments, the cleavable moiety is a phosphate or phosphodiester linkage between an oligonucleotide and a conjugate moiety or conjugate group.

In certain embodiments, a cleavable moiety comprises or consists of one or more linker-nucleosides. In certain such embodiments, the one or more linker-nucleosides are linked to one another and/or to the remainder of the oligomeric compound through cleavable bonds. In certain embodiments, such cleavable bonds are unmodified phosphodiester bonds. In certain embodiments, a cleavable moiety is 2'-deoxynucleoside that is attached to either the 3' or 5'-terminal nucleoside of an oligonucleotide by a phosphodiester internucleoside linkage and covalently attached to the remainder of the conjugate linker or conjugate moiety by a phosphate or phosphorothioate internucleoside linkage. In certain such embodiments, the cleavable moiety is 2'-deoxyadenosine.

3. Cell-Targeting Moieties

In certain embodiments, a conjugate group comprises a cell-targeting moiety. In certain embodiments, a conjugate group has the general formula:

$$\underbrace{[\text{Ligand}-\text{Tether}]_n-[\text{Branching group}]_m}_{\text{Cell-targeting moiety}}-\underbrace{[\text{Linker Moiety}]_j-[\text{Cleavable Linker Moiety}]_k}_{\text{Conjugate Linker}}-\wr$$

wherein n is from 1 to about 3, m is 0 when n is 1, m is 1 when n is 2 or greater, j is 1 or 0, and k is 1 or 0.

In certain embodiments, n is 1, j is 1 and k is 0. In certain embodiments, n is 1, j is 0 and k is 1. In certain embodiments, n is 1, j is 1 and k is 1. In certain embodiments, n is 2, j is 1 and k is 0. In certain embodiments, n is 2, j is 0 and k is 1. In certain embodiments, n is 2, j is 1 and k is 1. In certain embodiments, n is 3, j is 1 and k is 0. In certain embodiments, n is 3, j is 0 and k is 1. In certain embodiments, n is 3, j is 1 and k is 1.

In certain embodiments, conjugate groups comprise cell-targeting moieties that have at least one tethered ligand. In certain embodiments, cell-targeting moieties comprise two tethered ligands covalently attached to a branching group. In certain embodiments, cell-targeting moieties comprise three tethered ligands covalently attached to a branching group.

B. Certain Terminal Groups

In certain embodiments, oligomeric compounds comprise one or more terminal groups. In certain such embodiments, oligomeric compounds comprise a stabilized 5'-phosphate. Stabilized 5'-phosphates include, but are not limited to 5'-phosphonates, including, but not limited to 5'-vinylphosphonates. In certain embodiments, terminal groups comprise one or more abasic nucleosides and/or inverted nucleosides. In certain embodiments, terminal groups comprise one or more 2'-linked nucleosides. In certain such embodiments, the 2'-linked nucleoside is an abasic nucleoside.

III. Oligomeric Duplexes

In certain embodiments, oligomeric compounds described herein comprise an oligonucleotide, having a nucleobase sequence complementary to that of a target nucleic acid. In certain embodiments, an oligomeric compound is paired with a second oligomeric compound to form an oligomeric duplex. Such oligomeric duplexes comprise a first oligomeric compound having a portion complementary to a target nucleic acid and a second oligomeric compound having a portion complementary to the first oligomeric compound. In certain embodiments, the first oligomeric compound of an oligomeric duplex comprises or consists of (1) a modified or unmodified oligonucleotide and optionally a conjugate group and (2) a second modified or unmodified oligonucleotide and optionally a conjugate group. Either or both oligomeric compounds of an oligomeric duplex may comprise a conjugate group. The oligonucleotides of each oligomeric compound of an oligomeric duplex may include non-complementary overhanging nucleosides.

IV. Antisense Activity

In certain embodiments, oligomeric compounds and oligomeric duplexes are capable of hybridizing to a target nucleic acid, resulting in at least one antisense activity; such oligomeric compounds and oligomeric duplexes are antisense compounds. In certain embodiments, antisense compounds have antisense activity when they reduce the amount or activity of a target nucleic acid by 25% or more in the standard cell assay. In certain embodiments, antisense compounds selectively affect one or more target nucleic acid. Such antisense compounds comprise a nucleobase sequence that hybridizes to one or more target nucleic acid, resulting in one or more desired antisense activity and does not hybridize to one or more non-target nucleic acid or does not hybridize to one or more non-target nucleic acid in such a way that results in significant undesired antisense activity.

In certain antisense activities, hybridization of an antisense compound to a target nucleic acid results in recruitment of a protein that cleaves the target nucleic acid. For example, certain antisense compounds result in RNase H mediated cleavage of the target nucleic acid. RNase H is a cellular endonuclease that cleaves the RNA strand of an RNA:DNA duplex. The DNA in such an RNA:DNA duplex need not be unmodified DNA. In certain embodiments, described herein are antisense compounds that are sufficiently "DNA-like" to elicit RNase H activity. In certain embodiments, one or more non-DNA-like nucleoside in the gap of a gapmer is tolerated.

In certain antisense activities, an antisense compound or a portion of an antisense compound is loaded into an RNA-induced silencing complex (RISC), ultimately resulting in cleavage of the target nucleic acid. For example, certain antisense compounds result in cleavage of the target nucleic acid by Argonaute. Antisense compounds that are loaded into RISC are RNAi compounds. RNAi compounds may be double-stranded (siRNA) or single-stranded (ssRNA).

In certain embodiments, hybridization of an antisense compound to a target nucleic acid does not result in recruitment of a protein that cleaves that target nucleic acid. In certain embodiments, hybridization of the antisense compound to the target nucleic acid results in alteration of splicing of the target nucleic acid. In certain embodiments, hybridization of an antisense compound to a target nucleic acid results in inhibition of a binding interaction between the target nucleic acid and a protein or other nucleic acid. In certain embodiments, hybridization of an antisense compound to a target nucleic acid results in alteration of translation of the target nucleic acid.

Antisense activities may be observed directly or indirectly. In certain embodiments, observation or detection of an antisense activity involves observation or detection of a change in an amount of a target nucleic acid or protein encoded by such target nucleic acid, a change in the ratio of splice variants of a nucleic acid or protein and/or a phenotypic change in a cell or subject.

V. Certain Target Nucleic Acids

In certain embodiments, oligomeric compounds comprise or consist of an oligonucleotide comprising a portion that is complementary to a target nucleic acid. In certain embodiments, the target nucleic acid is an endogenous RNA molecule. In certain embodiments, the target nucleic acid encodes a protein. In certain such embodiments, the target nucleic acid is selected from: a mature mRNA and a pre-mRNA, including intronic, exonic and untranslated regions. In certain embodiments, the target nucleic acid is a mature mRNA. In certain embodiments, the target nucleic acid is a pre-mRNA. In certain embodiments, the target region is entirely within an intron. In certain embodiments, the target region spans an intron/exon junction. In certain embodiments, the target region is at least 50% within an intron.

A. Complementarity/Mismatches to the Target Nucleic Acid

It is possible to introduce mismatch bases without eliminating activity. For example, Gautschi et al (J. Natl. Cancer Inst. 93:463-471, March 2001) demonstrated the ability of an oligonucleotide having 100% complementarity to the bcl-2 mRNA and having 3 mismatches to the bcl-xL mRNA to reduce the expression of both bcl-2 and bcl-xL in vitro and in vivo. Furthermore, this oligonucleotide demonstrated potent anti-tumor activity in vivo. Maher and Dolnick (Nuc. Acid. Res. 16:3341-3358, 1988) tested a series of tandem 14 nucleobase oligonucleotides, and a 28 and 42 nucleobase oligonucleotides comprised of the sequence of two or three of the tandem oligonucleotides, respectively, for their ability to arrest translation of human DHFR in a rabbit reticulocyte assay. Each of the three 14 nucleobase oligonucleotides alone was able to inhibit translation, albeit at a more modest level than the 28 or 42 nucleobase oligonucleotides.

In certain embodiments, oligonucleotides are complementary to the target nucleic acid over the entire length of the oligonucleotide. In certain embodiments, oligonucleotides are 99%, 95%, 90%, 85%, or 80% complementary to the target nucleic acid. In certain embodiments, oligonucleotides are at least 80% complementary to the target nucleic acid over the entire length of the oligonucleotide and comprise a portion that is 100% or fully complementary to a target nucleic acid. In certain embodiments, the portion of full complementarity is 6, 7, 8, 9, 10, 11, 12, 13, 14, 15, 16, 17, 18, 19, 20, 21, 22, 23, or 24 nucleobases in length.

In certain embodiments, oligonucleotides comprise one or more mismatched nucleobases relative to the target nucleic acid. In certain embodiments, antisense activity against the target is reduced by such mismatch, but activity against a non-target is reduced by a greater amount. Thus, in certain embodiments selectivity of the oligonucleotide is improved. In certain embodiments, the mismatch is specifically positioned within an oligonucleotide having a gapmer motif. In certain embodiments, the mismatch is at position 1, 2, 3, 4, 5, 6, 7, 8, 9, 10, or 11 from the 5'-end of the gap region. In certain embodiments, the mismatch is at position 1, 2, 3, 4, 5, or 6 from the 5'-end of the 5' wing region or the 3' wing region.

B. PLP1

In certain embodiments, oligomeric compounds comprise or consist of an oligonucleotide that is complementary to a target nucleic acid, wherein the target nucleic acid is a PLP1 nucleic acid. In certain embodiments, the PLP1 nucleic acid has the sequence set forth in SEQ ID NO: 1 (GENBANK Accession No. NM_001128834.2) or SEQ ID NO: 2 (GENBANK Accession No. NC_000023.11 truncated from nucleotides 103773001 to 103795000).

In certain embodiments, contacting a cell with an oligomeric compound complementary to SEQ ID NO: 1 or SEQ ID NO: 2 reduces the amount of PLP1 RNA in a cell, and in certain embodiments reduces the amount of PLP1 protein in a cell. In certain embodiments, contacting a cell with a modified oligonucleotide complementary to SEQ ID NO: 1 or SEQ ID NO: 2 reduces the amount of PLP1 RNA in a cell, and in certain embodiments reduces the amount of PLP1 protein in a cell. In certain embodiments, the cell is in vitro. In certain embodiments, the cell is in a subject. In certain embodiments, contacting a cell in a subject with an oligomeric compound complementary to SEQ ID NO: 1 or SEQ ID NO: 2 ameliorates one or more symptom or hallmark of a leukodystrophy. In certain embodiments, the leukodystrophy is PMD. In certain embodiments, the symptom or hallmark is selected from hypotonia, nystagmus, optic atrophy, respiratory distress, motor delays, cognitive dysfunction, speech dysfunction, spasticity, ataxia, seizures, and choreiform movements. In certain embodiments, the oligomeric compound consists of a modified oligonucleotide.

In certain embodiments, an oligomeric compound complementary to SEQ ID NO: 1 or SEQ ID NO: 2 is capable of reducing the detectable amount of PLP1 RNA in vitro by at least 10%, at least 20%, at least 30%, at least 40%, at least 50%, at least 60%, at least 70%, at least 80%, or at least 90% in the standard in vitro assay. In certain embodiments, an oligomeric compound complementary to SEQ ID NO: 1 or SEQ ID NO: 2 is capable of reducing the detectable amount of PLP1 protein in vitro by at least 10%, at least 20%, at least 30%, at least 40%, at least 50%, at least 60%, at least 70%, at least 80%, or at least 90% in the standard in vitro assay. In certain embodiments, an oligomeric compound complementary to SEQ ID NO: 1 or SEQ ID NO: 2 is capable of reducing the detectable amount of PLP1 RNA in vivo by at least 10%, at least 20%, at least 30%, at least 40%, at least 50%, at least 60%, at least 70%, at least 80%, or at least 90% when administered according to the standard in vivo assay. In certain embodiments, an oligomeric compound complementary to SEQ ID NO: 1 or SEQ ID NO: 2 is capable of reducing the detectable amount of PLP1 protein in vivo by at least 10%, at least 20%, at least 30%, at least 40%, at least 50%, at least 60%, at least 70%, at least 80%, or at least 90% when administered according to the standard in vivo assay. In certain embodiments, an oligomeric compound complementary to SEQ ID NO: 1 or SEQ ID NO: 2, is capable of reducing the detectable amount of PLP1 RNA in the CSF of a subject by at least 10%, at least 20%, at least 30%, at least 40%, at least 50%, at least 60%, at least 70%, at least 80%, or at least 90%. In certain embodiments, an oligomeric compound complementary to SEQ ID NO: 1 or SEQ ID NO: 2, is capable of reducing the detectable amount of PLP1 protein in the CSF of a subject by at least 10%, at least 20%, at least 30%, at least 40%, at least 50%, at least 60%, at least 70%, at least 80%, or at least 90%.

C. Certain Target Nucleic Acids in Certain Tissues

In certain embodiments, oligomeric compounds comprise or consist of an oligonucleotide comprising a region that is complementary to a target nucleic acid, wherein the target nucleic acid is expressed in a pharmacologically relevant tissue. In certain embodiments, the pharmacologically relevant tissues are the cells and tissues that comprise the central nervous system (CNS). Such tissues include the brain and spinal cord. In certain embodiments, the pharmacologically relevant tissues include white matter tracts across the brain and spinal cord, such tissues include the corpus callosum, cortex, cerebellum, hippocampus, brain stem, striatum, and spinal cord. In certain embodiments, the pharmacologically relevant tissues include the cortex, cerebellum, hippocampus, brain stem, and spinal cord. In certain embodiments, the pharmacologically relevant cells are oligodendrocytes and oligodendrocyte progenitor cells. In certain embodiments, the pharmacologically relevant cells are Schwann cells or Schwann cell progenitors.

VI. Certain Pharmaceutical Compositions

In certain embodiments, described herein are pharmaceutical compositions comprising one or more oligomeric compounds. In certain embodiments, the one or more oligomeric compounds each consists of a modified oligonucleotide. In certain embodiments, the pharmaceutical composition comprises a pharmaceutically acceptable diluent or carrier. In certain embodiments, a pharmaceutical composition comprises or consists of a sterile saline solution and one or more oligomeric compound. In certain embodiments, the sterile saline is pharmaceutical grade saline. In certain embodiments, a pharmaceutical composition comprises or consists of one or more oligomeric compound and sterile water. In certain embodiments, the sterile water is pharmaceutical grade water. In certain embodiments, a pharmaceutical composition comprises or consists of one or more oligomeric compound and phosphate-buffered saline (PBS). In certain embodiments, the sterile PBS is pharmaceutical grade PBS. In certain embodiments, a pharmaceutical composition comprises or consists of one or more oligomeric compound and artificial cerebrospinal fluid ("artificial CSF" or "aCSF"). In certain embodiments, the artificial cerebrospinal fluid is pharmaceutical grade.

In certain embodiments, a pharmaceutical composition comprises a modified oligonucleotide and artificial cerebrospinal fluid. In certain embodiments, a pharmaceutical composition consists of a modified oligonucleotide and artificial cerebrospinal fluid. In certain embodiments, a pharmaceutical composition consists essentially of a modified oligonucleotide and artificial cerebrospinal fluid. In certain embodiments, the artificial cerebrospinal fluid is pharmaceutical grade.

In certain embodiments, pharmaceutical compositions comprise one or more oligomeric compound and one or more excipients. In certain embodiments, excipients are selected from water, salt solutions, alcohol, polyethylene glycols, gelatin, lactose, amylase, magnesium stearate, talc, silicic acid, viscous paraffin, hydroxymethylcellulose and polyvinylpyrrolidone.

In certain embodiments, oligomeric compounds may be admixed with pharmaceutically acceptable active and/or inert substances for the preparation of pharmaceutical compositions or formulations. Compositions and methods for the formulation of pharmaceutical compositions depend on a number of criteria, including, but not limited to, route of administration, extent of disease, or dose to be administered.

In certain embodiments, pharmaceutical compositions comprising an oligomeric compound encompass any pharmaceutically acceptable salts of the oligomeric compound, esters of the oligomeric compound, or salts of such esters. In certain embodiments, pharmaceutical compositions comprising oligomeric compounds comprising one or more oligonucleotide, upon administration to a subject, including a human, are capable of providing (directly or indirectly) the biologically active metabolite or residue thereof. Accordingly, for example, the disclosure is also drawn to pharmaceutically acceptable salts of oligomeric compounds, prodrugs, pharmaceutically acceptable salts of such prodrugs, and other bioequivalents. Suitable pharmaceutically acceptable salts include, but are not limited to, sodium and potassium salts. In certain embodiments, prodrugs comprise one or more conjugate group attached to an oligonucleotide, wherein the conjugate group is cleaved by endogenous nucleases within the body.

Lipid moieties have been used in nucleic acid therapies in a variety of methods. In certain such methods, the nucleic acid, such as an oligomeric compound, is introduced into preformed liposomes or lipoplexes made of mixtures of cationic lipids and neutral lipids. In certain methods, DNA complexes with mono- or poly-cationic lipids are formed without the presence of a neutral lipid. In certain embodiments, a lipid moiety is selected to increase distribution of a pharmaceutical agent to a particular cell or tissue. In certain embodiments, a lipid moiety is selected to increase distribution of a pharmaceutical agent to fat tissue. In certain embodiments, a lipid moiety is selected to increase distribution of a pharmaceutical agent to muscle tissue.

In certain embodiments, pharmaceutical compositions comprise a delivery system. Examples of delivery systems include, but are not limited to, liposomes and emulsions. Certain delivery systems are useful for preparing certain pharmaceutical compositions including those comprising hydrophobic compounds. In certain embodiments, certain organic solvents such as dimethylsulfoxide are used.

In certain embodiments, pharmaceutical compositions comprise one or more tissue-specific delivery molecules designed to deliver the one or more pharmaceutical agents comprising an oligomeric compound provided herein to specific tissues or cell types. For example, in certain embodiments, pharmaceutical compositions include liposomes coated with a tissue-specific antibody.

In certain embodiments, pharmaceutical compositions comprise a co-solvent system. Certain of such co-solvent systems comprise, for example, benzyl alcohol, a nonpolar surfactant, a water-miscible organic polymer, and an aqueous phase. In certain embodiments, such co-solvent systems are used for hydrophobic compounds. A non-limiting example of such a co-solvent system is the VPD co-solvent system, which is a solution of absolute ethanol comprising 3% w/v benzyl alcohol, 8% w/v of the nonpolar surfactant Polysorbate 80™ and 65% w/v polyethylene glycol 300. The proportions of such co-solvent systems may be varied considerably without significantly altering their solubility and toxicity characteristics. Furthermore, the identity of co-solvent components may be varied: for example, other surfactants may be used instead of Polysorbate 80™; the fraction size of polyethylene glycol may be varied; other biocompatible polymers may replace polyethylene glycol, e.g., polyvinyl pyrrolidone; and other sugars or polysaccharides may substitute for dextrose.

In certain embodiments, pharmaceutical compositions are prepared for oral administration. In certain embodiments, pharmaceutical compositions are prepared for buccal administration. In certain embodiments, a pharmaceutical composition is prepared for administration by injection (e.g., intravenous, subcutaneous, intramuscular, intrathecal (IT), intracerebroventricular (ICV), intraneural, perineural, etc.). In certain of such embodiments, a pharmaceutical composition comprises a carrier and is formulated in aqueous solution, such as water or physiologically compatible buffers such as Hanks's solution, Ringer's solution, or physiological saline buffer. In certain embodiments, other ingredients are included (e.g., ingredients that aid in solubility or serve as preservatives). In certain embodiments, injectable suspensions are prepared using appropriate liquid carriers, suspending agents and the like. Certain pharmaceutical compositions for injection are presented in unit dosage form, e.g., in ampoules or in multi-dose containers. Certain pharmaceutical compositions for injection are suspensions, solutions or emulsions in oily or aqueous vehicles, and may contain formulatory agents such as suspending, stabilizing and/or dispersing agents. Certain solvents suitable for use in pharmaceutical compositions for injection include, but are not limited to, lipophilic solvents and fatty oils, such as sesame oil, synthetic fatty acid esters, such as ethyl oleate or triglycerides, and liposomes.

Under certain conditions, certain compounds disclosed herein act as acids. Although such compounds may be drawn or described in protonated (free acid) form, or ionized and in association with a cation (salt) form, aqueous solutions of such compounds exist in equilibrium among such forms. For example, a phosphate linkage of an oligonucleotide in aqueous solution exists in equilibrium among free acid, anion and salt forms. Unless otherwise indicated, compounds described herein are intended to include all such forms. Moreover, certain oligonucleotides have several such linkages, each of which is in equilibrium. Thus, oligonucleotides in solution exist in an ensemble of forms at multiple positions all at equilibrium. The term "oligonucleotide" is intended to include all such forms. Drawn structures necessarily depict a single form. Nevertheless, unless otherwise indicated, such drawings are likewise intended to include corresponding forms. Herein, a structure depicting the free acid of a compound followed by the term "or salt thereof" expressly includes all such forms that may be fully or partially protonated/de-protonated/in association with a cation. In certain instances, one or more specific cation is identified.

In certain embodiments, modified oligonucleotides or oligomeric compounds are in aqueous solution with sodium. In certain embodiments, modified oligonucleotides or oligomeric compounds are in aqueous solution with potassium. In certain embodiments, modified oligonucleotides or oligomeric compounds are in PBS. In certain embodiments, modified oligonucleotides or oligomeric compounds are in water. In certain such embodiments, the pH of the solution is adjusted with NaOH and/or HCl to achieve a desired pH.

Herein, certain specific doses are described. A dose may be in the form of a dosage unit. For clarity, a dose (or dosage unit) of a modified oligonucleotide or an oligomeric compound in milligrams indicates the mass of the free acid form of the modified oligonucleotide or oligomeric compound. As described above, in aqueous solution, the free acid is in equilibrium with anionic and salt forms. However, for the purpose of calculating dose, it is assumed that the modified oligonucleotide or oligomeric compound exists as a solvent-free, sodium-acetate free, anhydrous, free acid. For example, where a modified oligonucleotide or an oligomeric compound is in solution comprising sodium (e.g., saline), the modified oligonucleotide or oligomeric compound may be partially or fully de-protonated and in association with Na+ ions. However, the mass of the protons are nevertheless counted toward the weight of the dose, and the mass of the Na+ ions are not counted toward the weight of the dose. Thus, for example, a dose, or dosage unit, of 10 mg of Compound No. 1362458 equals the number of fully protonated molecules that weighs 10 mg. This would be equivalent to 10.47 mg of solvent-free, sodium acetate-free, anhydrous sodiated Compound No. 1362458. And, for example, a dose, or dosage unit, of 10 mg of Compound No. 1523605 equals the number of fully protonated molecules that weighs 10 mg. This would be equivalent to 10.59 mg of solvent-free, sodium acetate-free, anhydrous sodiated Compound No. 1523605. When an oligomeric compound comprises a conjugate group, the mass of the conjugate group is included in calculating the dose of such oligomeric compound. If the conjugate group also has an acid, the conjugate group is likewise assumed to be fully protonated for the purpose of calculating dose.

VI. Certain Compositions

1. Compound No. 1363235

In certain embodiments, Compound No. 1363235 is characterized as a 5-10-5 MOE gapmer having a sequence (from 5' to 3') of TGTAGTACAAATCTTTCCTT (SEQ ID NO: 2101), wherein each of nucleosides 1-5 and 16-20 (from 5' to 3') are 2'-MOE nucleosides and each of nucleosides 6-15 are 2'-β-D-deoxynucleosides, wherein the internucleoside linkages between nucleosides 2 to 3, 3 to 4, 4 to 5, 5 to 6, 16 to 17, and 17 to 18 are phosphodiester internucleoside linkages, the internucleoside linkages between nucleosides 1 to 2, 6 to 7, 7 to 8, 8 to 9, 9 to 10, 10 to 11, 11 to 12, 12 to 13, 13 to 14, 14 to 15, 15 to 16, 18 to 19, and 19 to 20 are phosphorothioate internucleoside linkages, and wherein each cytosine is a 5-methyl cytosine.

In certain embodiments, Compound No. 1363235 is represented by the following chemical notation:

(SEQ ID NO: 2101)

$T_{es}G_{eo}T_{eo}A_{eo}G_{eo}T_{ds}A_{ds}{}^{m}C_{ds}A_{ds}A_{ds}A_{ds}T_{ds}{}^{m}C_{ds}T_{ds}T_{ds}T_{eo}{}^{m}C_{eo}{}^{m}C_{es}T_{es}T_{e}$, wherein:

A=an adenine nucleobase, $^{m}$C=a 5-methyl cytosine nucleobase,

G=a guanine nucleobase,

T=a thymine nucleobase, e=a 2'-MOE sugar moiety, d=a 2'-β-D-deoxyribosyl sugar moiety, s=a phosphorothioate internucleoside linkage, and o=a phosphodiester internucleoside linkage.

In certain embodiments, Compound No. 1363235 is represented by the following chemical structure:

Structure 1. Compound No. 1363235

(SEQ ID NO: 2101)

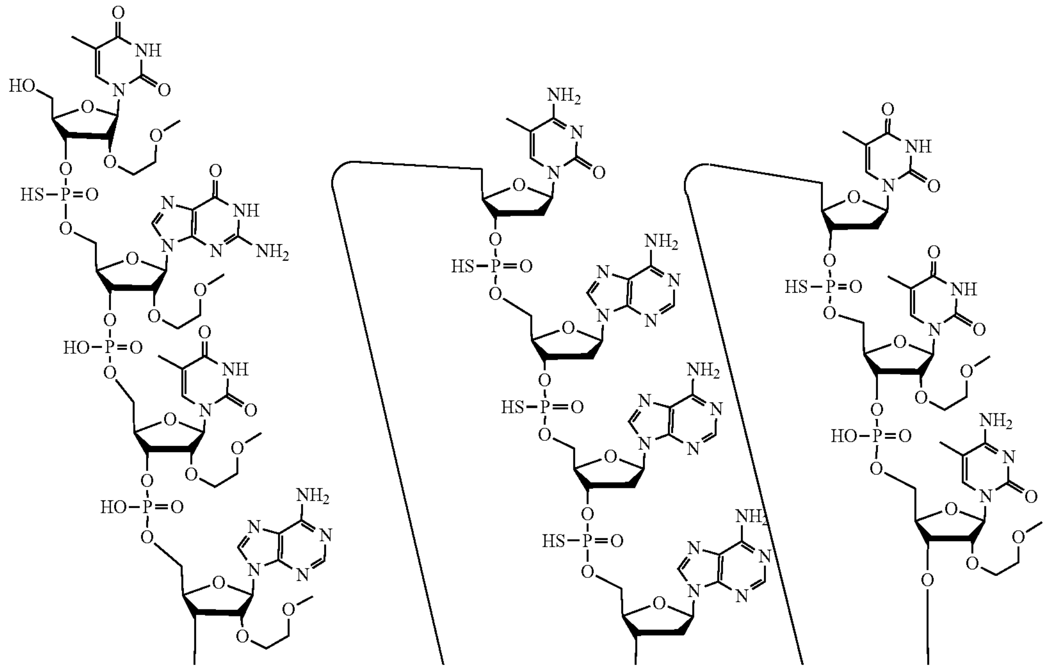

-continued
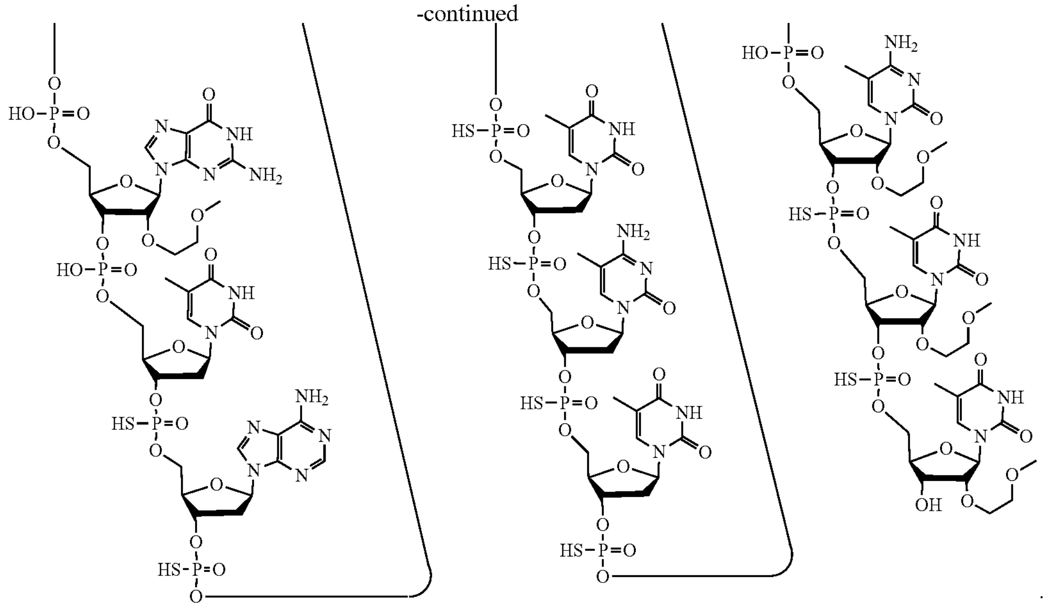
In certain embodiments, the sodium salt of Compound No. 1363235 is represented by the following chemical structure:
Structure 2. The sodium salt of Compound No. 1363235
(SEQ ID NO: 2101)
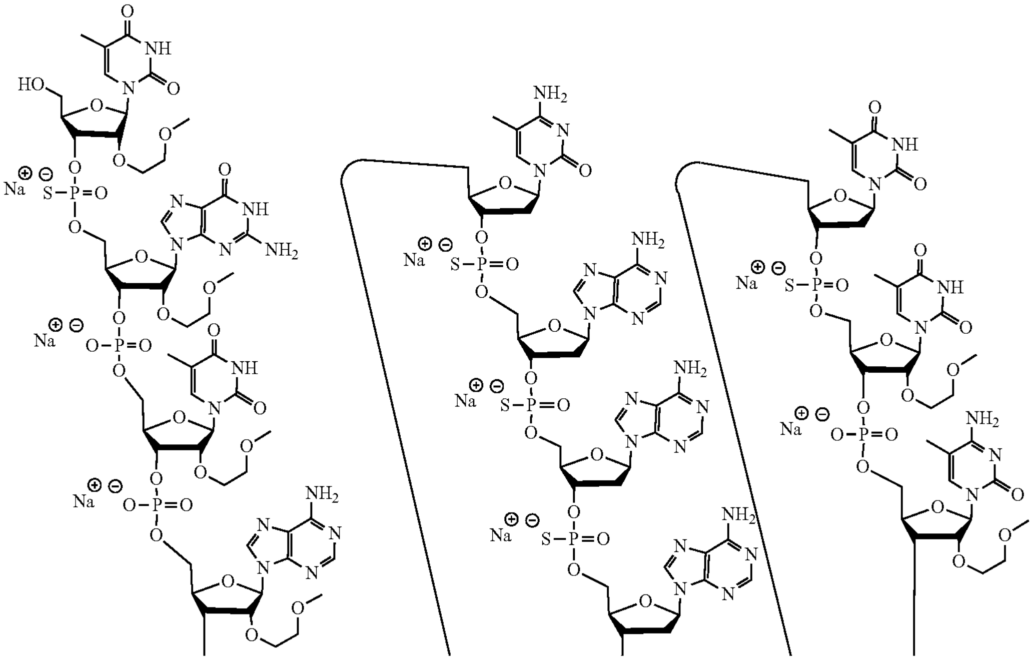

-continued

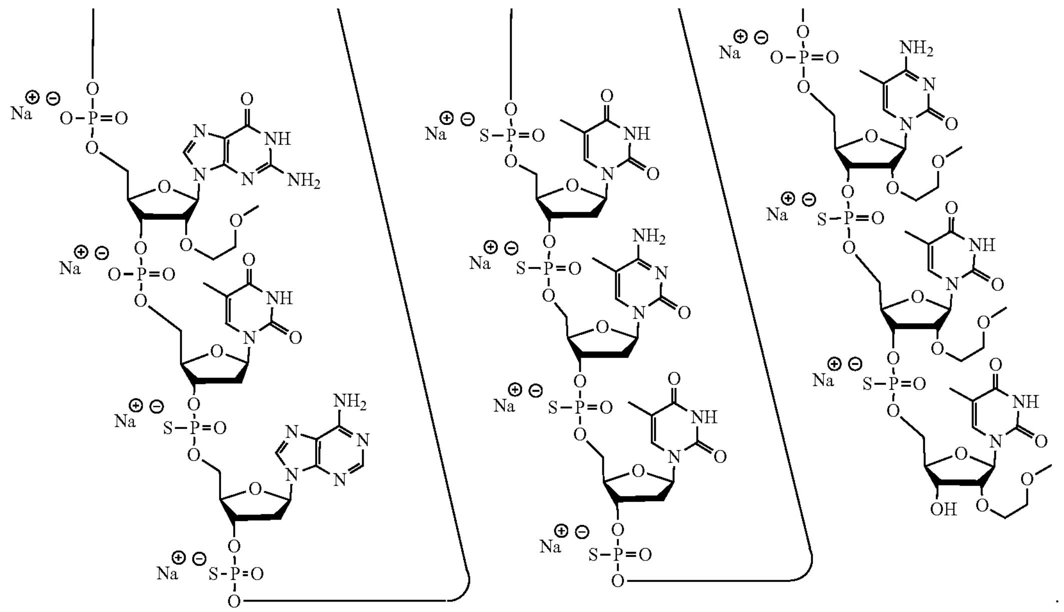

2. Compound No. 1523601

In certain embodiments, Compound No. 1523601 is characterized as a 6-10-4 MOE gapmer having a sequence (from 5' to 3') of ACAAATCTTTCCTTCAATTA (SEQ ID NO: 682), wherein each of nucleosides 1-6 and 17-20 (from 5' to 3') are 2'-MOE nucleosides and each of nucleosides 7-16 are 2'-B-D-deoxynucleosides, wherein the internucleoside linkages between nucleosides 2 to 3, 3 to 4, 4 to 5, 5 to 6, 6 to 7, and 17 to 18 are phosphodiester internucleoside linkages, the internucleoside linkages between nucleosides 1 to 2, 7 to 8, 8 to 9, 9 to 10, 10 to 11, 11 to 12, 12 to 13, 13 to 14, 14 to 15, 15 to 16, 16 to 17, 18 to 19, and 19 to 20 are phosphorothioate internucleoside linkages, and wherein each cytosine is a 5-methyl cytosine.

In certain embodiments, Compound No. 1523601 is represented by the following chemical notation:

(SEQ ID NO: 682)

$A_{es}{}^{m}C_{eo}A_{eo}A_{eo}A_{eo}T_{eo}{}^{m}C_{ds}T_{ds}T_{ds}T_{ds}{}^{m}C_{ds}{}^{m}C_{ds}T_{ds}T_{ds}{}^{m}C_{ds}$ $A_{ds}A_{eo}T_{es}T_{es}A_{e}$, wherein:

A=an adenine nucleobase, $^{m}$C=a 5-methyl cytosine nucleobase,

G=a guanine nucleobase,

T=a thymine nucleobase, e=a 2'-MOE sugar moiety, d=a 2'-β-D-deoxyribosyl sugar moiety, s=a phosphorothioate internucleoside linkage, and o=a phosphodiester internucleoside linkage.

In certain embodiments, Compound No. 1523601 is represented by the following chemical structure:

Structure 3. Compound No. 1523601
(SEQ ID NO: 682)
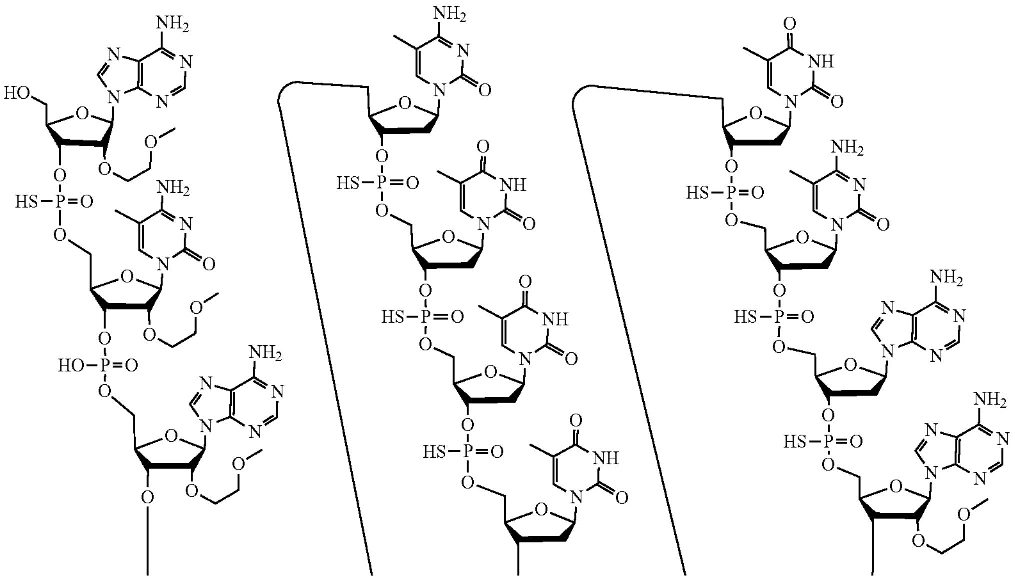
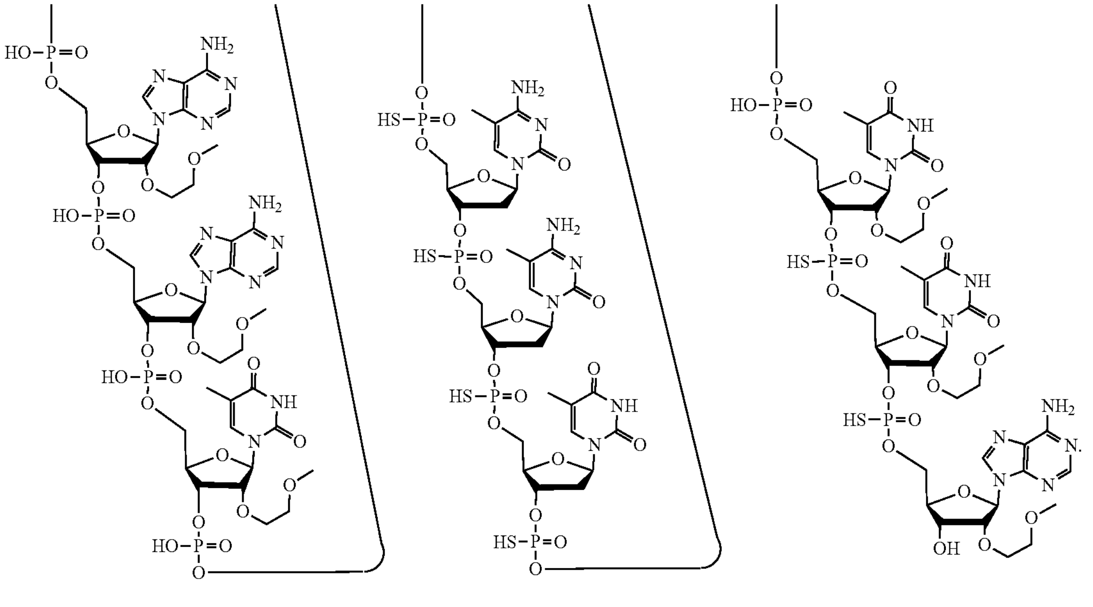

In certain embodiments, the sodium salt of Compound No. 1523601 is represented by the following chemical structure:

Structure 4. The sodium salt of Compound No. 1523601

(SEQ ID NO: 682)

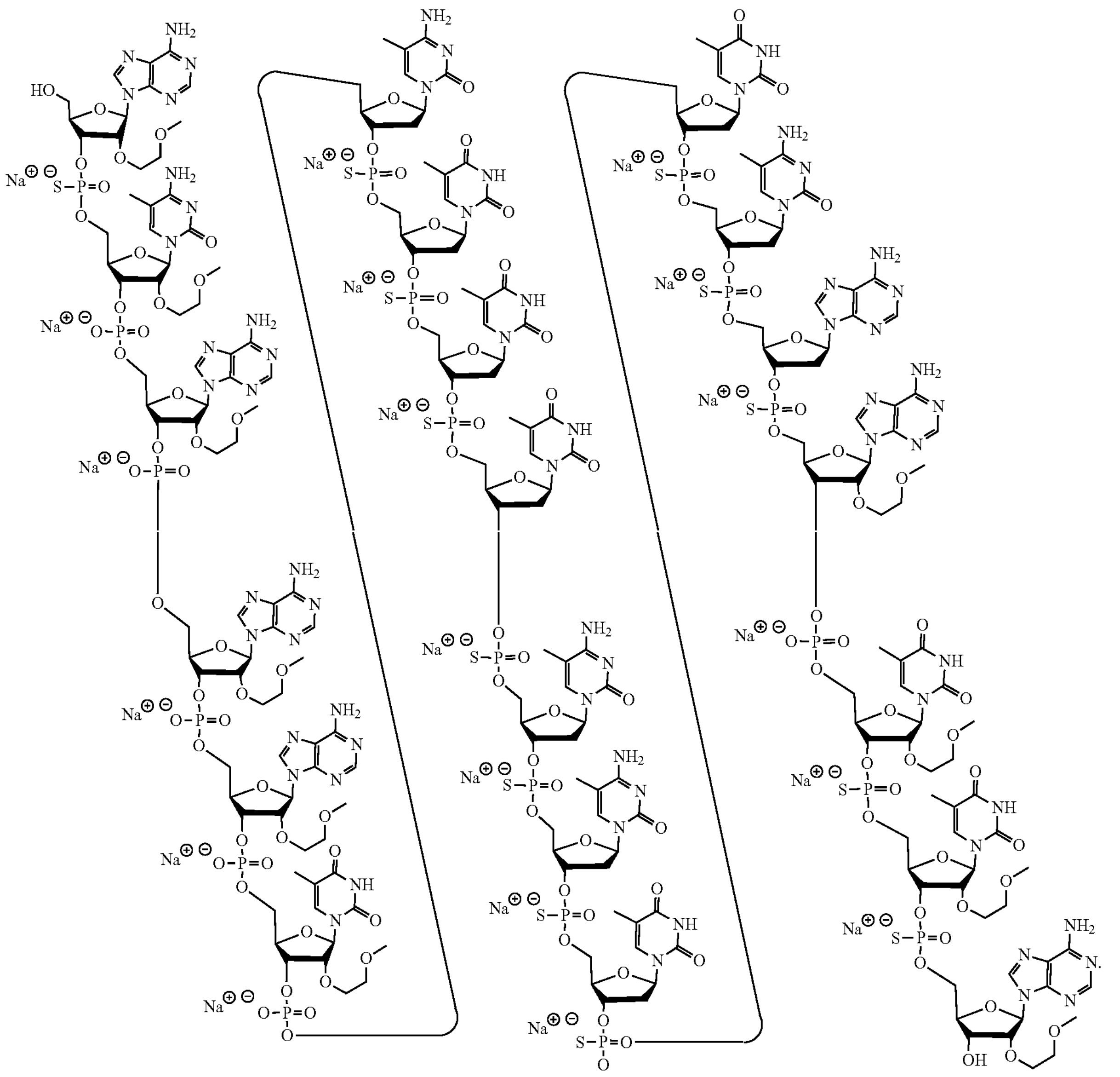

3. Compound No. 1523605

In certain embodiments, Compound No. 1523605 is characterized as a 6-10-4 MOE gapmer having a sequence (from 5' to 3') of CAGATGTTCATCTCTTCACA (SEQ ID NO: 1124), wherein each of nucleosides 1-6 and 17-20 (from 5' to 3') are 2'-MOE nucleosides and each of nucleosides 7-16 are 2'-β3-D-deoxynucleosides, wherein the internucleoside linkages between nucleosides 2 to 3, 3 to 4, 4 to 5, 5 to 6, 6 to 7, and 17 to 18 are phosphodiester internucleoside linkages, the internucleoside linkages between nucleosides 1 to 2, 7 to 8, 8 to 9, 9 to 10, 10 to 11, 11 to 12, 12 to 13, 13 to 14, 14 to 15, 15 to 16, 16 to 17, 18 to 19, and 19 to 20 are phosphorothioate internucleoside linkages, and wherein each cytosine is a 5-methyl cytosine.

In certain embodiments, Compound No. 1523605 is represented by the following chemical notation:

(SEQ ID NO: 1124)

$^{m}C_{es}A_{eo}G_{eo}A_{eo}T_{eo}G_{eo}T_{ds}T_{ds}{}^{m}C_{ds}A_{ds}T_{ds}{}^{m}C_{ds}T_{ds}{}^{m}C_{ds}T_{ds}$ $T_{ds}{}^{m}C_{eo}A_{es}{}^{m}C_{es}A_{e}$, wherein:

A=an adenine nucleobase, $^{m}C$=a 5-methyl cytosine nucleobase,

G=a guanine nucleobase,

T=a thymine nucleobase, e=a 2'-MOE sugar moiety, d=a 2'-β-D-deoxyribosyl sugar moiety, s=a phosphorothioate internucleoside linkage, and o=a phosphodiester internucleoside linkage.

In certain embodiments, Compound No. 1523605 is represented by the following chemical structure:

Structure 5. Compound No. 1523605

(SEQ ID NO: 1124)

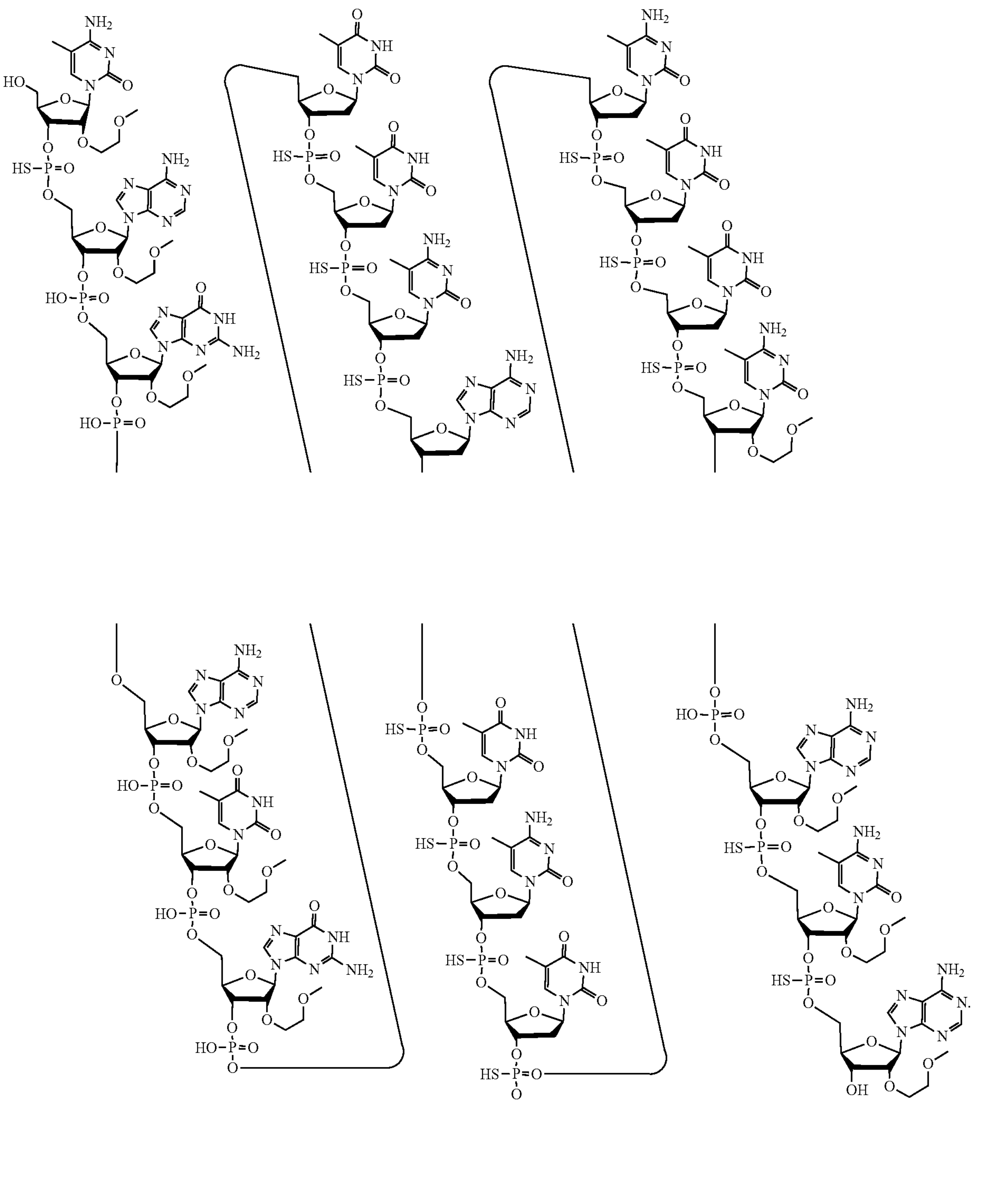

In certain embodiments, the sodium salt of Compound No. 1523605 is represented by the following chemical structure:

Structure 6. The sodium salt of Compound No. 1523605

(SEQ ID NO: 1124)

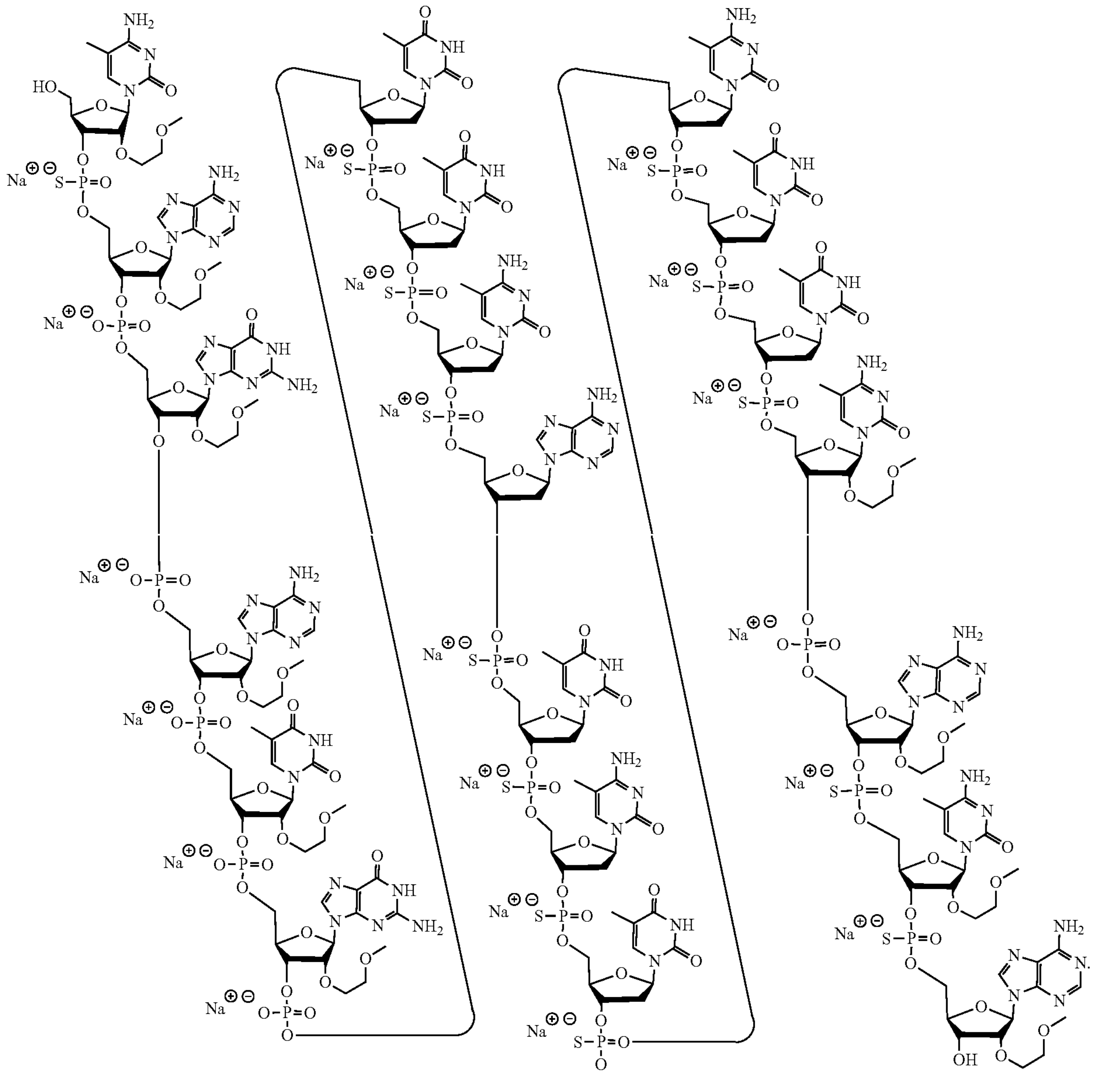

4. Compound No. 1523608

In certain embodiments, Compound No. 1523608 is characterized as a 6-10-4 MOE gapmer having a sequence (from 5' to 3') of CATCAGATGTTCATCTCTTC (SEQ ID NO: 2145), wherein each of nucleosides 1-6 and 17-20 (from 5' to 3') are 2'-MOE nucleosides and each of nucleosides 7-16 are 2'-β-D-deoxynucleosides, wherein the internucleoside linkages between nucleosides 2 to 3, 3 to 4, 4 to 5, 5 to 6, 6 to 7, and 17 to 18 are phosphodiester internucleoside linkages, the internucleoside linkages between nucleosides 1 to 2, 7 to 8, 8 to 9, 9 to 10, 10 to 11, 11 to 12, 12 to 13, 13 to 14, 14 to 15, 15 to 16, 16 to 17, 18 to 19, and 19 to 20 are phosphorothioate internucleoside linkages, and wherein each cytosine is a 5-methyl cytosine.

In certain embodiments, Compound No. 1523608 is represented by the following chemical notation:

(SEQ ID NO: 2145)

$^{m}C_{es}A_{eo}T_{eo}{}^{m}C_{eo}A_{eo}G_{eo}A_{ds}T_{ds}G_{ds}T_{ds}T_{ds}{}^{m}C_{ds}A_{ds}T_{ds}{}^{m}C_{ds}$ $T_{ds}{}^{m}C_{eo}T_{es}T_{es}{}^{m}C_{e}$,

A=an adenine nucleobase,
$^{m}$C=a 5-methyl cytosine nucleobase,
G=a guanine nucleobase,
T=a thymine nucleobase,
e=a 2'-MOE sugar moiety,
d=a 2'-β-D-deoxyribosyl sugar moiety,
s=a phosphorothioate internucleoside linkage, and
o=a phosphodiester internucleoside linkage.

In certain embodiments, Compound No. 1523608 is represented by the following chemical structure:

Structure 7. Compound No. 1523608

(SEQ ID NO: 2145)

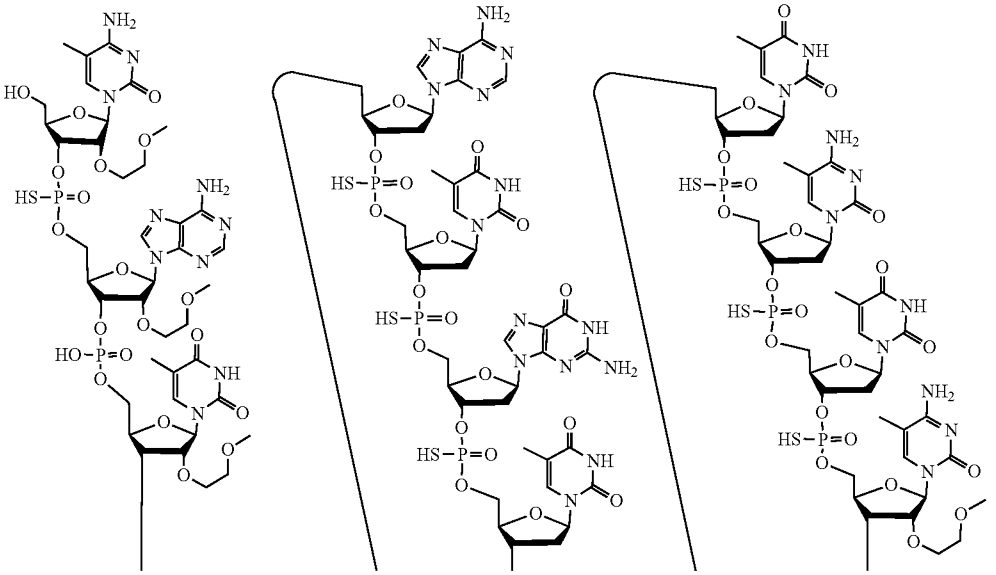

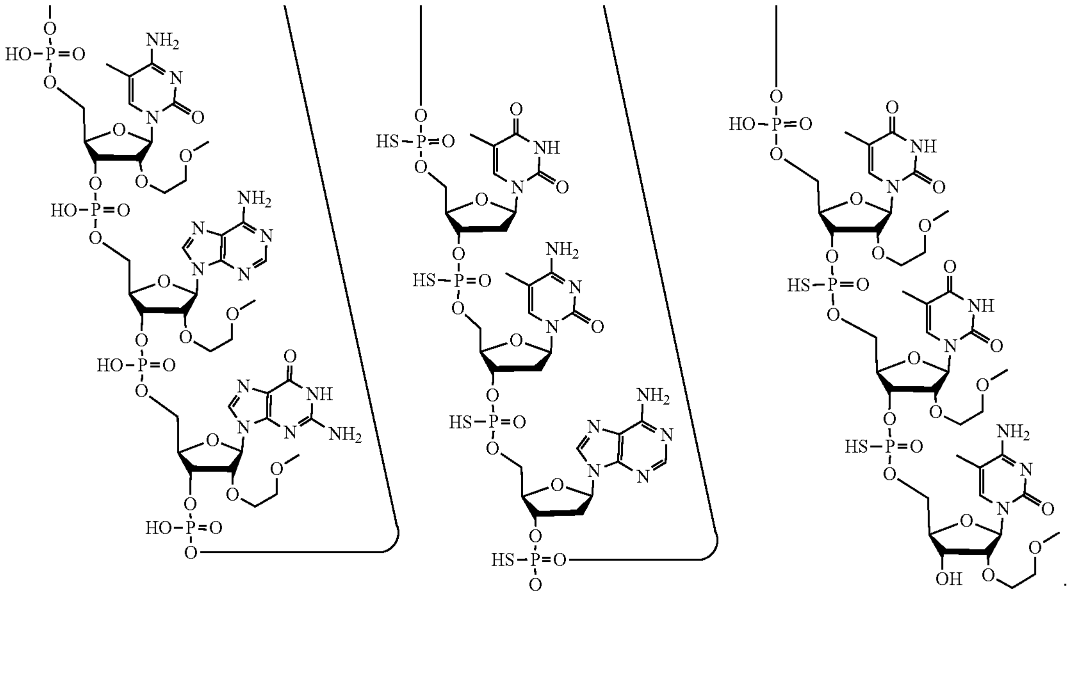

In certain embodiments, the sodium salt of Compound No. 1523608 is represented by the following chemical structure:

Structure 8. The sodium salt of Compound No. 1523608

(SEQ ID NO: 2145)

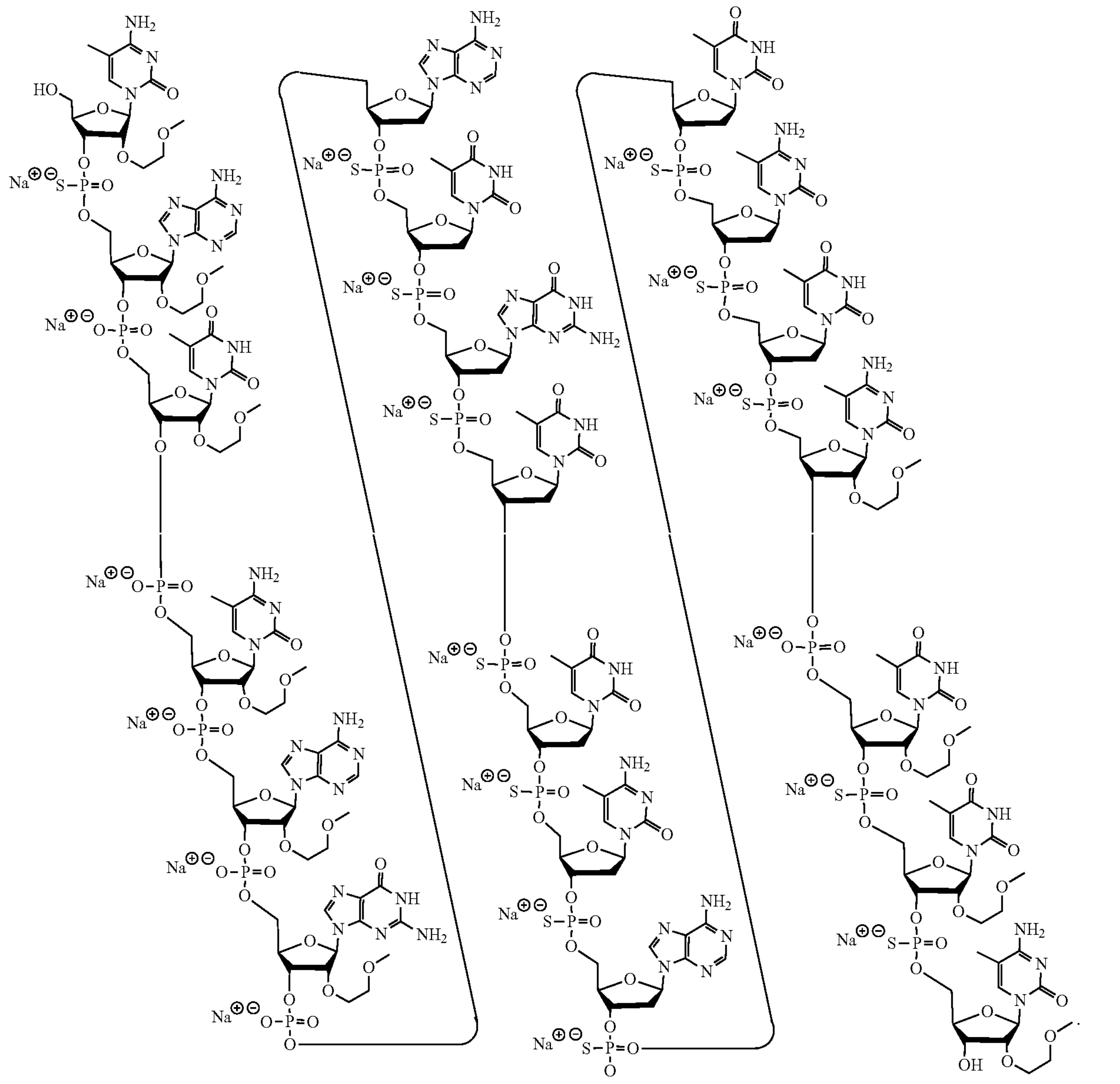

5. Compound No. 1362445

In certain embodiments, Compound No. 1362445 is characterized as a 5-10-5 MOE gapmer having a sequence (from 5' to 3') of CCCAATAGATTCAACTAGCC (SEQ ID NO: 134), wherein each of nucleosides 1-5 and 16-20 (from 5' to 3') are 2'-MOE nucleosides and each of nucleosides 6-15 are 2'-β-D-deoxynucleosides, wherein the internucleoside linkages between nucleosides 2 to 3, 3 to 4, 4 to 5, 5 to 6, 16 to 17, and 17 to 18 are phosphodiester internucleoside linkages, the internucleoside linkages between nucleosides 1 to 2, 6 to 7, 7 to 8, 8 to 9, 9 to 10, 10 to 11, 11 to 12, 12 to 13, 13 to 14, 14 to 15, 15 to 16, 18 to 19, and 19 to 20 are phosphorothioate internucleoside linkages, and wherein each cytosine is a 5-methyl cytosine.

In certain embodiments, Compound No. 1362445 is represented by the following chemical notation:

(SEQ ID NO: 134)

$^{m}C_{es}{}^{m}C_{eo}{}^{m}C_{eo}A_{eo}A_{eo}T_{ds}A_{ds}G_{ds}A_{ds}T_{ds}T_{ds}{}^{m}C_{ds}A_{ds}A_{ds}{}^{m}C_{ds}$ $T_{eo}A_{eo}G_{es}{}^{m}C_{es}{}^{m}C_{e}$, wherein:

A=an adenine nucleobase, $^{m}$C=a 5-methyl cytosine nucleobase,

G=a guanine nucleobase,

T=a thymine nucleobase, e=a 2'-MOE sugar moiety, d=a 2'-β-D-deoxyribosyl sugar moiety, s=a phosphorothioate internucleoside linkage, and o=a phosphodiester internucleoside linkage.

6. Compound No. 1362449

In certain embodiments, Compound No. 1362449 is characterized as a 5-10-5 MOE gapmer having a sequence (from 5' to 3') of ACACAACTCTTTACAACAAA (SEQ ID NO: 411), wherein each of nucleosides 1-5 and 16-20 (from 5' to 3') are 2'-MOE nucleosides and each of nucleosides 6-15 are 2'-β-D-deoxynucleosides, wherein the internucleoside linkages between nucleosides 2 to 3, 3 to 4, 4 to 5, 5 to 6, 16 to 17, and 17 to 18 are phosphodiester internucleoside linkages, the internucleoside linkages between nucleosides 1 to 2, 6 to 7, 7 to 8, 8 to 9, 9 to 10, 10 to 11, 11 to 12, 12 to 13, 13 to 14, 14 to 15, 15 to 16, 18 to 19, and 19 to 20 are phosphorothioate internucleoside linkages, and wherein each cytosine is a 5-methyl cytosine.

In certain embodiments, Compound No. 1362449 is represented by the following chemical notation:

(SEQ ID NO: 411)

$A_{es}{}^{m}C_{eo}A_{eo}{}^{m}C_{eo}A_{eo}A_{ds}{}^{m}C_{ds}T_{ds}{}^{m}C_{ds}T_{ds}T_{ds}T_{ds}A_{ds}{}^{m}C_{ds}A_{ds}$ $A_{eo}{}^{m}C_{eo}A_{es}A_{es}A_{e}$, wherein:

A=an adenine nucleobase, $^{m}$C=a 5-methyl cytosine nucleobase,

G=a guanine nucleobase,

T=a thymine nucleobase, e=a 2'-MOE sugar moiety, d=a 2'-β-D-deoxyribosyl sugar moiety, s=a phosphorothioate internucleoside linkage, and o=a phosphodiester internucleoside linkage.

7. Compound No. 1362458

In certain embodiments, Compound No. 1362458 is characterized as a 5-10-5 MOE gapmer having a sequence (from 5' to 3') of TCTCCAGACATTTCTGATGC (SEQ ID NO: 934), wherein each of nucleosides 1-5 and 16-20 (from 5' to 3') are 2'-MOE nucleosides and each of nucleosides 6-15 are 2'-β-D-deoxynucleosides, wherein the internucleoside linkages between nucleosides 2 to 3, 3 to 4, 4 to 5, 5 to 6, 16 to 17, and 17 to 18 are phosphodiester internucleoside linkages, the internucleoside linkages between nucleosides 1 to 2, 6 to 7, 7 to 8, 8 to 9, 9 to 10, 10 to 11, 11 to 12, 12 to 13, 13 to 14, 14 to 15, 15 to 16, 18 to 19, and 19 to 20 are phosphorothioate internucleoside linkages, and wherein each cytosine is a 5-methyl cytosine.

In certain embodiments, Compound No. 1362458 is represented by the following chemical notation:

(SEQ ID NO: 934)

$T_{es}{}^{m}C_{eo}T_{eo}{}^{m}C_{eo}{}^{m}C_{eo}A_{ds}G_{ds}A_{ds}{}^{m}C_{ds}A_{ds}T_{ds}T_{ds}T_{ds}{}^{m}C_{ds}T_{ds}$ $G_{eo}A_{eo}T_{es}G_{es}{}^{m}C_{e}$, wherein:

A=an adenine nucleobase, $^{m}$C=a 5-methyl cytosine nucleobase,

G=a guanine nucleobase,

T=a thymine nucleobase, e=a 2'-MOE sugar moiety, d=a 2'-β-D-deoxyribosyl sugar moiety, s=a phosphorothioate internucleoside linkage, and o=a phosphodiester internucleoside linkage.

8. Compound No. 1362602

In certain embodiments, Compound No. 1362602 is characterized as a 5-10-5 MOE gapmer having a sequence (from 5' to 3') of GTGTGTTAAAATTGCAATTC (SEQ ID NO: 1238), wherein each of nucleosides 1-5 and 16-20 (from 5' to 3') are 2'-MOE nucleosides and each of nucleosides 6-15 are 2'-β-D-deoxynucleosides, wherein the internucleoside linkages between nucleosides 2 to 3, 3 to 4, 4 to 5, 5 to 6, 16 to 17, and 17 to 18 are phosphodiester internucleoside linkages, the internucleoside linkages between nucleosides 1 to 2, 6 to 7, 7 to 8, 8 to 9, 9 to 10, 10 to 11, 11 to 12, 12 to 13, 13 to 14, 14 to 15, 15 to 16, 18 to 19, and 19 to 20 are phosphorothioate internucleoside linkages, and wherein each cytosine is a 5-methyl cytosine.

In certain embodiments, Compound No. 1362602 is represented by the following chemical notation:

(SEQ ID NO: 1238)

$G_{es}T_{eo}G_{eo}T_{eo}G_{eo}T_{ds}T_{ds}A_{ds}A_{ds}A_{ds}A_{ds}$ $T_{ds}T_{ds}G_{ds}{}^{m}C_{ds}A_{eo}A_{eo}T_{es}T_{es}{}^{m}C_{e}$, wherein:

A=an adenine nucleobase, $^{m}$C=a 5-methyl cytosine nucleobase,

G=a guanine nucleobase,

T=a thymine nucleobase, e=a 2'-MOE sugar moiety, d=a 2'-β-D-deoxyribosyl sugar moiety, s=a phosphorothioate internucleoside linkage, and o=a phosphodiester internucleoside linkage.

9. Compound No. 1362842

In certain embodiments, Compound No. 1362842 is characterized as a 5-10-5 MOE gapmer having a sequence (from 5' to 3') of ATTGCAATTCTATATCAGAA (SEQ ID NO: 2010), wherein each of nucleosides 1-5 and 16-20 (from 5' to 3') are 2'-MOE nucleosides and each of nucleosides 6-15 are 2'-β-D-deoxynucleosides, wherein the internucleoside linkages between nucleosides 2 to 3, 3 to 4, 4 to 5, 5 to 6, 16 to 17, and 17 to 18 are phosphodiester internucleoside linkages, the internucleoside linkages between nucleosides 1 to 2, 6 to 7, 7 to 8, 8 to 9, 9 to 10, 10 to 11, 11 to 12, 12 to 13, 13 to 14, 14 to 15, 15 to 16, 18 to 19, and 19 to 20 are phosphorothioate internucleoside linkages, and wherein each cytosine is a 5-methyl cytosine.

In certain embodiments, Compound No. 1362842 is represented by the following chemical notation:

(SEQ ID NO: 2010)

$A_{es}T_{eo}T_{eo}G_{eo}{}^{m}C_{eo}A_{ds}A_{ds}T_{ds}T_{ds}{}^{m}C_{ds}$ $T_{ds}A_{ds}T_{ds}A_{ds}T_{ds}{}^{m}C_{eo}A_{eo}G_{es}A_{es}A_{e}$,

A=an adenine nucleobase, $^{m}$C=a 5-methyl cytosine nucleobase,

G=a guanine nucleobase,

T=a thymine nucleobase, e=a 2'-MOE sugar moiety, d=a 2'-β-D-deoxyribosyl sugar moiety, s=a phosphorothioate internucleoside linkage, and o=a phosphodiester internucleoside linkage.

10. Compound No. 1362892

In certain embodiments, Compound No. 1362892 is characterized as a 5-10-5 MOE gapmer having a sequence (from 5' to 3') of ATGTGATCTATATCAGGAGA (SEQ ID NO: 1772), wherein each of nucleosides 1-5 and 16-20 (from 5' to 3') are 2'-MOE nucleosides and each of nucleosides 6-15 are 2'-β-D-deoxynucleosides, wherein the internucleoside linkages between nucleosides 2 to 3, 3 to 4, 4 to 5, 5 to 6, 16 to 17, and 17 to 18 are phosphodiester internucleoside linkages, the internucleoside linkages between nucleosides 1 to 2, 6 to 7, 7 to 8, 8 to 9, 9 to 10, 10 to 11, 11 to 12, 12 to 13, 13 to 14, 14 to 15, 15 to 16, 18 to 19, and 19 to 20 are phosphorothioate internucleoside linkages, and wherein each cytosine is a 5-methyl cytosine.

In certain embodiments, Compound No. 1362892 is represented by the following chemical notation:

(SEQ ID NO: 1772)

$A_{es}T_{eo}G_{eo}T_{eo}G_{eo}A_{ds}T_{ds}{}^{m}C_{ds}T_{ds}A_{ds}$ $T_{ds}A_{ds}T_{ds}{}^{m}C_{ds}A_{ds}G_{eo}G_{eo}A_{es}G_{es}A_{e}$, wherein:

A=an adenine nucleobase, $^{m}$C=a 5-methyl cytosine nucleobase,

G=a guanine nucleobase,

T=a thymine nucleobase, e=a 2'-MOE sugar moiety, d=a 2'-β-D-deoxyribosyl sugar moiety, s=a phosphorothioate internucleoside linkage, and o=a phosphodiester internucleoside linkage.

11. Compound No. 1363013

In certain embodiments, Compound No. 1363013 is characterized as a 5-10-5 MOE gapmer having a sequence (from 5' to 3') of ACCAGAGGGCCATCTCAGGT (SEQ ID NO: 881), wherein each of nucleosides 1-5 and 16-20 (from 5' to 3') are 2'-MOE nucleosides and each of nucleosides 6-15 are 2'-β-D-deoxynucleosides, wherein the internucleoside linkages between nucleosides 2 to 3, 3 to 4, 4 to 5, 5 to 6, 16 to 17, and 17 to 18 are phosphodiester internucleoside linkages, the internucleoside linkages between nucleosides 1 to 2, 6 to 7, 7 to 8, 8 to 9, 9 to 10, 10 to 11, 11 to 12, 12 to 13, 13 to 14, 14 to 15, 15 to 16, 18 to 19, and 19 to 20 are phosphorothioate internucleoside linkages, and wherein each cytosine is a 5-methyl cytosine.

In certain embodiments, Compound No. 1363013 is represented by the following chemical notation:

(SEQ ID NO: 881)

$A_{es}{}^{m}C_{eo}{}^{m}C_{eo}A_{eo}G_{eo}A_{ds}G_{ds}G_{ds}G_{ds}{}^{m}C_{ds}$ ${}^{m}C_{ds}A_{ds}T_{ds}{}^{m}C_{ds}T_{ds}{}^{m}C_{eo}A_{eo}G_{es}G_{es}T_{e}$, wherein:

A=an adenine nucleobase, $^{m}$C=a 5-methyl cytosine nucleobase,

G=a guanine nucleobase,

T=a thymine nucleobase, e=a 2'-MOE sugar moiety, d=a 2'-β-D-deoxyribosyl sugar moiety, s=a phosphorothioate internucleoside linkage, and o=a phosphodiester internucleoside linkage.

12. Compound No. 1363398

In certain embodiments, Compound No. 1363398 is characterized as a 5-10-5 MOE gapmer having a sequence (from 5' to 3') of GCATCAGATGTTCATCTCTT (SEQ ID NO: 1050), wherein each of nucleosides 1-5 and 16-20 (from 5' to 3') are 2'-MOE nucleosides and each of nucleosides 6-15 are 2'-β-D-deoxynucleosides, wherein the internucleoside linkages between nucleosides 2 to 3, 3 to 4, 4 to 5, 5 to 6, 16 to 17, and 17 to 18 are phosphodiester internucleoside linkages, the internucleoside linkages between nucleosides 1 to 2, 6 to 7, 7 to 8, 8 to 9, 9 to 10, 10 to 11, 11 to 12, 12 to 13, 13 to 14, 14 to 15, 15 to 16, 18 to 19, and 19 to 20 are phosphorothioate internucleoside linkages, and wherein each cytosine is a 5-methyl cytosine.

In certain embodiments, Compound No. 1363398 is represented by the following chemical notation:

(SEQ ID NO: 1050)

$G_{es}{}^{m}C_{eo}A_{eo}T_{eo}{}^{m}C_{eo}A_{ds}G_{ds}A_{ds}T_{ds}G_{ds}$ $T_{ds}T_{ds}{}^{m}C_{ds}A_{ds}T_{ds}{}^{m}C_{eo}T_{eo}{}^{m}C_{e}ST_{es}T_{e}$, wherein:

A=an adenine nucleobase, $^{m}$C=a 5-methyl cytosine nucleobase,

G=a guanine nucleobase,

T=a thymine nucleobase, e=a 2'-MOE sugar moiety, d=a 2'-β-D-deoxyribosyl sugar moiety, s=a phosphorothioate internucleoside linkage, and o=a phosphodiester internucleoside linkage.

13. Compound No. 1363557

In certain embodiments, Compound No. 1363557 is characterized as a 5-10-5 MOE gapmer having a sequence (from 5' to 3') of CCTCCATTCCTTTGTGACTT (SEQ ID NO: 1449), wherein each of nucleosides 1-5 and 16-20 (from 5' to 3') are 2'-MOE nucleosides and each of nucleosides 6-15 are 2'-β-D-deoxynucleosides, wherein the internucleoside linkages between nucleosides 2 to 3, 3 to 4, 4 to 5, 5 to 6, 16 to 17, and 17 to 18 are phosphodiester internucleoside linkages, the internucleoside linkages between nucleosides 1 to 2, 6 to 7, 7 to 8, 8 to 9, 9 to 10, 10 to 11, 11 to 12, 12 to 13, 13 to 14, 14 to 15, 15 to 16, 18 to 19, and 19 to 20 are phosphorothioate internucleoside linkages, and wherein each cytosine is a 5-methyl cytosine.

In certain embodiments, Compound No. 1363557 is represented by the following chemical notation:

(SEQ ID NO: 1449)

${}^{m}C_{es}{}^{m}C_{eo}T_{eo}{}^{m}C_{eo}{}^{m}C_{eo}A_{ds}T_{ds}T_{ds}{}^{m}C_{ds}{}^{m}C_{ds}T_{ds}T_{ds}T_{ds}G_{ds}$ $T_{ds}G_{eo}A_{eo}{}^{m}C_{es}T_{es}T_{e}$, wherein:

A=an adenine nucleobase, $^{m}$C=a 5-methyl cytosine nucleobase,

G=a guanine nucleobase,

T=a thymine nucleobase, e=a 2'-MOE sugar moiety, d=a 2'-β-D-deoxyribosyl sugar moiety, s=a phosphorothioate internucleoside linkage, and o=a phosphodiester internucleoside linkage.

VIII. Certain Hotspot Regions

In certain embodiments, nucleobases in the ranges specified below comprise a hotspot region of PLP1 nucleic acid. In certain embodiments, modified oligonucleotides that are complementary to a portion of a hotspot region of PLP1 nucleic acid achieve an average of 50% or greater reduction of PLP1 RNA in vitro in the standard in vitro assay. In certain embodiments, modified oligonucleotides that are complementary to a portion of a hotspot region of PLP1 nucleic acid achieve an average of 50% or greater reduction of PLP1 RNA in vivo in the standard in vivo assay.

1. Nucleobases 9198-9222 of SEQ ID NO: 2

In certain embodiments, nucleobases 9198-9222 of SEQ ID NO: 2 comprise a hotspot region. In certain embodiments, modified oligonucleotides are complementary to a portion of nucleobases 9198-9222 of SEQ ID NO: 2. In certain embodiments, modified oligonucleotides are 20 nucleobases in length. In certain embodiments, modified oligonucleotides are 18 nucleobases in length. In certain embodiments, modified oligonucleotides are 16, 17, 18, 19, 20, 21, or 22 nucleobases in length. In certain embodiments, modified oligonucleotides consist of 17-19 or 21-30 linked nucleosides. In certain embodiments, modified oligonucleotides are gapmers. In certain embodiments, the gapmers are MOE gapmers. In certain embodiments, the gapmers are 5-10-5 MOE gapmers. In certain embodiments, the gapmers are 6-10-4 MOE gapmers. In certain embodiments, the gapmers are 4-10-6 MOE gapmers. In certain embodiments, the gapmers are 4-8-6 MOE gapmers. In certain embodiments, the gapmers are 6-8-4 MOE gapmers. In certain embodiments, the gapmers are 5-8-5 MOE gapmers. In certain embodiments, the gapmers have the sugar motif in order from 5' to 3': eeeeeddddddddddeeeee or eeeeeeddddddddddeeee, wherein 'd' represents a 2'-β-D-deoxyribosyl sugar moiety, and 'e' represents a 2'-MOE sugar moiety. In certain embodiments, the gapmers comprise a 2'-substituted nucleoside in the gap. In certain embodiments, the 2'-substituted nucleoside comprises a 2'-OMe sugar moiety. In certain embodiments, the 2'-substituted nucleoside is at position 2 of the gap (5' to 3').

In certain embodiments, all of the internucleoside linkages of the modified oligonucleotides are phosphorothioate internucleoside linkages. In certain embodiments, the internucleoside linkages of the modified oligonucleotides are phosphorothioate internucleoside linkages and phosphodiester internucleoside linkages. In certain embodiments, the phosphodiester ("o") and phosphorothioate ("s") internucleoside linkages are arranged in the order from 5' to 3': soooossssssssssooss or soooooossssssssssoss, wherein each "s" represents a phosphorothioate internucleoside linkage and each "o" represents a phosphodiester internucleoside linkage.

The nucleobase sequences of SEQ ID NOs: 1050, 1124, 2145, 2151, 2152, and 2153 are complementary to a portion of nucleobases 9198-9222 of SEQ ID NO: 2.

The nucleobase sequences of Compound Nos.: 1363398, 1363516, 1523604, 1523605, 1523606, 1523607, 1523608, and 1523609 are complementary to a portion of nucleobases 9198-9222 of SEQ ID NO: 2.

In certain embodiments, modified oligonucleotides complementary to a portion of nucleobases 9198-9222 of SEQ ID NO: 2 achieve at least 65% reduction of PLP1 RNA in the standard in vitro assay. In certain embodiments, modified oligonucleotides complementary to a portion of nucleobases 9198-9222 of SEQ ID NO: 2 achieve an average of 71.5% reduction of PLP1 RNA in the standard in vitro assay.

2. Nucleobases 13702-13766 of SEQ ID NO: 2

In certain embodiments, nucleobases 13702-13766 of SEQ ID NO: 2 comprise a hotspot region. In certain embodiments, modified oligonucleotides are complementary to a portion of nucleobases 13702-13766 of SEQ ID NO: 2. In certain embodiments, modified oligonucleotides are 20 nucleobases in length. In certain embodiments, modified oligonucleotides are 18 nucleobases in length. In certain embodiments, modified oligonucleotides are 16, 17, 18, 19, 20, 21, or 22 nucleobases in length. In certain embodiments, modified oligonucleotides consist of 17-19 or 21-30 linked nucleosides. In certain embodiments, modified oligonucleotides are gapmers. In certain embodiments, the gapmers are MOE gapmers. In certain embodiments, the gapmers are 5-10-5 MOE gapmers. In certain embodiments, the gapmers are 6-10-4 MOE gapmers. In certain embodiments, the gapmers are 4-10-6 MOE gapmers. In certain embodiments, the gapmers are 4-8-6 MOE gapmers. In certain embodiments, the gapmers are 6-8-4 MOE gapmers. In certain embodiments, the gapmers are 5-8-5 MOE gapmers. In certain embodiments, the gapmers have the sugar motif in order from 5' to 3': eeeeeddddddddddeeeee or eeeeeeddddddddddeeee, wherein 'd' represents a 2'-β-D-deoxyribosyl sugar moiety, and 'e' represents a 2'-MOE sugar moiety. In certain embodiments, the gapmers comprise a 2'-substituted nucleoside in the gap. In certain embodiments, the 2'-substituted nucleoside comprises a 2'-OMe sugar moiety. In certain embodiments, the 2'-substituted nucleoside is at position 2 of the gap (5' to 3').

In certain embodiments, all of the internucleoside linkages of the modified oligonucleotides are phosphorothioate internucleoside linkages. In certain embodiments, the internucleoside linkages of the modified oligonucleotides are phosphorothioate internucleoside linkages and phosphodiester internucleoside linkages. In certain embodiments, the phosphodiester ("o") and phosphorothioate ("s") internucleoside linkages are arranged in the order from 5' to 3': soooossssssssssooss or soooooossssssssssoss, wherein each "s" represents a phosphorothioate internucleoside linkage and each "o" represents a phosphodiester internucleoside linkage.

The nucleobase sequences of SEQ ID NOs: 36, 86, 114, 164, 191, 242, 269, 426, 523, 602, 691, and 780 are complementary to a portion of nucleobases 13702-13766 of SEQ ID NO: 2.

The nucleobase sequences of Compound Nos.: 1218139, 1218140, 1218141, 1218142, 1218341, 1218342, 1218343, 1362839, 1363565, 1363589, 1363758, and 1364150 are complementary to a portion of nucleobases 13702-13766 of SEQ ID NO: 2.

In certain embodiments, modified oligonucleotides complementary to a portion of nucleobases 13702-13766 of SEQ ID NO: 2 achieve at least 60% reduction of PLP1 RNA in the standard in vitro assay. In certain embodiments, modified oligonucleotides complementary to a portion of nucleobases 13702-13766 of SEQ ID NO: 2 achieve an average of 68.6% reduction of PLP1 RNA in the standard in vitro assay.

3. Nucleobases 14037-14062 of SEQ ID NO: 2

In certain embodiments, nucleobases 14037-14062 of SEQ ID NO: 2 comprise a hotspot region. In certain embodiments, modified oligonucleotides are complementary to a portion of nucleobases 14037-14062 of SEQ ID NO: 2. In certain embodiments, modified oligonucleotides are 20 nucleobases in length. In certain embodiments, modified oligonucleotides are 18 nucleobases in length. In certain embodiments, modified oligonucleotides are 16, 17, 18, 19, 20, 21, or 22 nucleobases in length. In certain embodiments, modified oligonucleotides consist of 17-19 or 21-30 linked nucleosides. In certain embodiments, modified oligonucleotides are gapmers. In certain embodiments, the gapmers are MOE gapmers. In certain embodiments, the gapmers are 5-10-5 MOE gapmers. In certain embodiments, the gapmers are 6-10-4 MOE gapmers. In certain embodiments, the gapmers are 4-10-6 MOE gapmers. In certain embodiments, the gapmers are 4-8-6 MOE gapmers. In certain embodiments, the gapmers are 6-8-4 MOE gapmers. In certain embodiments, the gapmers are 5-8-5 MOE gapmers. In certain embodiments, the gapmers have the sugar motif in order from 5' to 3': eeeeeddddddddddeeeee or eeeeeeddddddddddeeee, wherein 'd' represents a 2'-β-D-deoxyribosyl sugar moiety, and 'e' represents a 2'-MOE sugar moiety. In certain embodiments, the gapmers comprise a 2'-substituted nucleoside in the gap. In certain embodiments, the 2'-substituted nucleoside comprises a 2'-OMe sugar moiety. In certain embodiments, the 2'-substituted nucleoside is at position 2 of the gap (5' to 3').

In certain embodiments, all of the internucleoside linkages of the modified oligonucleotides are phosphorothioate internucleoside linkages. In certain embodiments, the internucleoside linkages of the modified oligonucleotides are phosphorothioate internucleoside linkages and phosphodiester internucleoside linkages. In certain embodiments, the phosphodiester ("o") and phosphorothioate ("s") internucleoside linkages are arranged in the order from 5' to 3': sooooossssssssssooss or soooooossssssssssoss, wherein each "s" represents a phosphorothioate internucleoside linkage and each "o" represents a phosphodiester internucleoside linkage.

The nucleobase sequences of SEQ ID NOs: 89, 167, 245, 322, and 323 are complementary to a portion of nucleobases 14037-14062 of SEQ ID NO: 2.

The nucleobase sequences of Compound Nos.: 1218352, 1218353, 1218354, 1362909, 1362866, 1218355, and 1218356 are complementary to a portion of nucleobases 14037-14062 of SEQ ID NO: 2.

In certain embodiments, modified oligonucleotides complementary to a portion of nucleobases 14037-14062 of SEQ ID NO: 2 achieve at least 64% reduction of PLP1 RNA in the standard in vitro assay. In certain embodiments, modified oligonucleotides complementary to a portion of nucleobases 14037-14062 of SEQ ID NO: 2 achieve an average of 79.9% reduction of PLP1 RNA in the standard in vitro assay.

4. Nucleobases 16761-16800 of SEQ ID NO: 2

In certain embodiments, nucleobases 16761-16800 of SEQ ID NO: 2 comprise a hotspot region. In certain embodiments, modified oligonucleotides are complementary to a portion of nucleobases 16761-16800 of SEQ ID NO: 2. In certain embodiments, modified oligonucleotides are 20 nucleobases in length. In certain embodiments, modified oligonucleotides are 18 nucleobases in length. In certain embodiments, modified oligonucleotides are 16, 17, 18, 19, 20, 21, or 22 nucleobases in length. In certain embodiments, modified oligonucleotides consist of 17-19 or 21-30 linked nucleosides. In certain embodiments, modified oligonucleotides are gapmers. In certain embodiments, the gapmers are MOE gapmers. In certain embodiments, the gapmers are 5-10-5 MOE gapmers. In certain embodiments, the gapmers are 6-10-4 MOE gapmers. In certain embodiments, the gapmers are 4-10-6 MOE gapmers. In certain embodiments, the gapmers are 4-8-6 MOE gapmers. In certain embodiments, the gapmers are 6-8-4 MOE gapmers. In certain embodiments, the gapmers are 5-8-5 MOE gapmers. In certain embodiments, the gapmers have the sugar motif in order from 5' to 3': eeeeeddddddddddeeeee or eeeeeeddddddddddeeee, wherein 'd' represents a 2'-β-D-deoxyribosyl sugar moiety, and 'e' represents a 2'-MOE sugar moiety. In certain embodiments, the gapmers comprise a 2'-substituted nucleoside in the gap. In certain embodiments, the 2'-substituted nucleoside comprises a 2'-OMe sugar moiety. In certain embodiments, the 2'-substituted nucleoside is at position 2 of the gap (5' to 3').

In certain embodiments, all of the internucleoside linkages of the modified oligonucleotides are phosphorothioate internucleoside linkages. In certain embodiments, the internucleoside linkages of the modified oligonucleotides are phosphorothioate internucleoside linkages and phosphodiester internucleoside linkages. In certain embodiments, the phosphodiester ("o") and phosphorothioate ("s") internucleoside linkages are arranged in the order from 5' to 3': sooooossssssssssooss or soooooossssssssssoss, wherein each "s" represents a phosphorothioate internucleoside linkage and each "o" represents a phosphodiester internucleoside linkage.

The nucleobase sequences of SEQ ID NOs: 720, 808, 904, 937, 1058, 1097, 1184, 1278, and 1340 are complementary to a portion of nucleobases 16761-16800 of SEQ ID NO: 2.

The nucleobase sequences of Compound Nos.: 1362547, 1362649, 1362825, 1363052, 1363131, 1363205, 1363559, 1363590, and 1363607 are complementary to a portion of nucleobases 16761-16800 of SEQ ID NO: 2.

In certain embodiments, modified oligonucleotides complementary to a portion of nucleobases 16761-16800 of SEQ ID NO: 2 achieve at least 60% reduction of PLP1 RNA in the standard in vitro assay. In certain embodiments, modified oligonucleotides complementary to a portion of nucleobases 16761-16800 of SEQ ID NO: 2 achieve an average of 70.7% reduction of PLP1 RNA in the standard in vitro assay.

5. Nucleobases 17558-17602 of SEQ ID NO: 2

In certain embodiments, nucleobases 17558-17602 of SEQ ID NO: 2 comprise a hotspot region. In certain embodiments, modified oligonucleotides are complementary to a portion of nucleobases 17558-17602 of SEQ ID NO: 2. In certain embodiments, modified oligonucleotides are 20 nucleobases in length. In certain embodiments, modified oligonucleotides are 18 nucleobases in length. In certain embodiments, modified oligonucleotides are 16, 17, 18, 19, 20, 21, or 22 nucleobases in length. In certain embodiments, modified oligonucleotides consist of 17-19 or 21-30 linked nucleosides. In certain embodiments, modified oligonucleotides are gapmers. In certain embodiments, the gapmers are MOE gapmers. In certain embodiments, the gapmers are 5-10-5 MOE gapmers. In certain embodiments, the gapmers are 6-10-4 MOE gapmers. In certain embodiments, the gapmers are 4-10-6 MOE gapmers. In certain embodiments, the gapmers are 4-8-6 MOE gapmers. In certain embodiments, the gapmers are 6-8-4 MOE gapmers. In certain embodiments, the gapmers are 5-8-5 MOE gapmers. In certain embodiments, the gapmers have the sugar motif in order from 5' to 3': eeeeeddddddddddeeeee or eeeeeeddddddddddeeee, wherein 'd' represents a 2'-β-D-deoxyribosyl sugar moiety, and 'e' represents a 2'-MOE sugar moiety. In certain embodiments, the gapmers comprise a 2'-substituted nucleoside in the gap. In certain embodiments, the 2'-substituted nucleoside comprises a 2'-OMe sugar moiety. In certain embodiments, the 2'-substituted nucleoside is at position 2 of the gap (5' to 3').

In certain embodiments, all of the internucleoside linkages of the modified oligonucleotides are phosphorothioate internucleoside linkages. In certain embodiments, the internucleoside linkages of the modified oligonucleotides are phosphorothioate internucleoside linkages and phosphodiester internucleoside linkages. In certain embodiments, the phosphodiester ("o") and phosphorothioate ("s") internucleoside linkages are arranged in the order from 5' to 3': sooooossssssssssooss or soooooossssssssssoss, wherein each "s" represents a phosphorothioate internucleoside linkage and each "o" represents a phosphodiester internucleoside linkage.

The nucleobase sequences of SEQ ID NOs: 40, 41, 117, 118, 195, 196, 273, 274, 588, 690 are complementary to a portion of nucleobases 17558-17602 of SEQ ID NO: 2.

The nucleobase sequence of Compound Nos.: 1218154, 1218155, 1218156, 1218157, 1218158, 1218159, 1218160, 1218161, 1363257, 1363439, and 1363756 are complementary to a portion of nucleobases 17558-17602 of SEQ ID NO: 2.

In certain embodiments, modified oligonucleotides complementary to a portion of nucleobases 17558-17602 of SEQ ID NO: 2 achieve at least 62% reduction of PLP1 RNA in the standard in vitro assay. In certain embodiments, modified oligonucleotides complementary to a portion of nucleobases 17558-17602 of SEQ ID NO: 2 achieve an average of 74.6% reduction of PLP1 RNA in the standard in vitro assay.

6. Nucleobases 17615-17667 of SEQ ID NO: 2

In certain embodiments, nucleobases 17615-17667 of SEQ ID NO: 2 comprise a hotspot region. In certain embodiments, modified oligonucleotides are complementary to a portion of nucleobases 17615-17667 of SEQ ID NO: 2. In certain embodiments, modified oligonucleotides are 20 nucleobases in length. In certain embodiments, modified oligonucleotides are 18 nucleobases in length. In certain embodiments, modified oligonucleotides are 16, 17, 18, 19, 20, 21, or 22 nucleobases in length. In certain embodiments, modified oligonucleotides consist of 17-19 or 21-30 linked nucleosides. In certain embodiments, modified oligonucleotides are gapmers. In certain embodiments, the gapmers are MOE gapmers. In certain embodiments, the gapmers are 5-10-5 MOE gapmers. In certain embodiments, the gapmers are 6-10-4 MOE gapmers. In certain embodiments, the gapmers are 4-10-6 MOE gapmers. In certain embodiments, the gapmers are 4-8-6 MOE gapmers. In certain embodiments, the gapmers are 6-8-4 MOE gapmers. In certain embodiments, the gapmers are 5-8-5 MOE gapmers. In certain embodiments, the gapmers have the sugar motif in order from 5' to 3': eeeeeddddddddddeeeee or eeeeeedddddddddeeee, wherein 'd' represents a 2'-β-D-deoxyribosyl sugar moiety, and 'e' represents a 2'-MOE sugar moiety. In certain embodiments, the gapmers comprise a 2'-substituted nucleoside in the gap. In certain embodiments, the 2'-substituted nucleoside comprises a 2'-OMe sugar moiety. In certain embodiments, the 2'-substituted nucleoside is at position 2 of the gap (5' to 3').

In certain embodiments, all of the internucleoside linkages of the modified oligonucleotides are phosphorothioate internucleoside linkages. In certain embodiments, the internucleoside linkages of the modified oligonucleotides are phosphorothioate internucleoside linkages and phosphodiester internucleoside linkages. In certain embodiments, the phosphodiester ("o") and phosphorothioate ("s") internucleoside linkages are arranged in the order from 5' to 3': sooosssssssssssooss or soooosssssssssssoss, wherein each "s" represents a phosphorothioate internucleoside linkage and each "o" represents a phosphodiester internucleoside linkage.

The nucleobase sequences of SEQ ID NOs: 42, 43, 119, 120, 197, 198, 275, 276, 373, 460, 1431, 1542, 1645, 1850, 1965, and 2109 are complementary to a portion of nucleobases 17615-17667 of SEQ ID NO: 2.

The nucleobase sequences of Compound Nos.: 1218162, 1218163, 1218164, 1218165, 1218166, 1218167, 1218168, 1218169, 1362484, 1362497, 1362517, 1362591, 1362749, 1362970, 1363246, 1363342, 1363415, 1363474, 1363544, 1363725, and 1363736 are complementary to a portion of nucleobases 17615-17667 of SEQ ID NO: 2.

In certain embodiments, modified oligonucleotides complementary to a portion of nucleobases 17615-17667 of SEQ ID NO: 2 achieve at least 28% reduction of PLP1 RNA in the standard in vitro assay. In certain embodiments, modified oligonucleotides complementary to a portion of nucleobases 17615-17667 of SEQ ID NO: 2 achieve an average of 74.4% reduction of PLP1 RNA in the standard in vitro assay.

7. Nucleobases 17853-17883 of SEQ ID NO: 2

In certain embodiments, nucleobases 17853-17883 of SEQ ID NO: 2 comprise a hotspot region. In certain embodiments, modified oligonucleotides are complementary to a portion of nucleobases 17853-17883 of SEQ ID NO: 2. In certain embodiments, modified oligonucleotides are 20 nucleobases in length. In certain embodiments, modified oligonucleotides are 18 nucleobases in length. In certain embodiments, modified oligonucleotides are 16, 17, 18, 19, 20, 21, or 22 nucleobases in length. In certain embodiments, modified oligonucleotides consist of 17-19 or 21-30 linked nucleosides. In certain embodiments, modified oligonucleotides are gapmers. In certain embodiments, the gapmers are MOE gapmers. In certain embodiments, the gapmers are 5-10-5 MOE gapmers. In certain embodiments, the gapmers are 6-10-4 MOE gapmers. In certain embodiments, the gapmers are 4-10-6 MOE gapmers. In certain embodiments, the gapmers are 4-8-6 MOE gapmers. In certain embodiments, the gapmers are 6-8-4 MOE gapmers. In certain embodiments, the gapmers are 5-8-5 MOE gapmers. In certain embodiments, the gapmers have the sugar motif in order from 5' to 3': eeeeeddddddddddeeeee or eeeeeedddddddddeeee, wherein 'd' represents a 2'-β-D-deoxyribosyl sugar moiety, and 'e' represents a 2'-MOE sugar moiety. In certain embodiments, the gapmers comprise a 2'-substituted nucleoside in the gap. In certain embodiments, the 2'-substituted nucleoside comprises a 2'-OMe sugar moiety. In certain embodiments, the 2'-substituted nucleoside is at position 2 of the gap (5' to 3').

In certain embodiments, all of the internucleoside linkages of the modified oligonucleotides are phosphorothioate internucleoside linkages. In certain embodiments, the internucleoside linkages of the modified oligonucleotides are phosphorothioate internucleoside linkages and phosphodiester internucleoside linkages. In certain embodiments, the phosphodiester ("o") and phosphorothioate ("s") internucleoside linkages are arranged in the order from 5' to 3': sooosssssssssssooss or soooosssssssssssoss, wherein each "s" represents a phosphorothioate internucleoside linkage and each "o" represents a phosphodiester internucleoside linkage.

The nucleobase sequences of SEQ ID NOs: 1451, 1499, 1543, 1654, 1733, 2154, and 2155 are complementary to a portion of nucleobases 17853-17883 of SEQ ID NO: 2.

The nucleobase sequences of Compound Nos.: 1362611, 1363392, 1363557, 1363795, 1364094, 1523610, 1523611, 1523612, and 1523613 are complementary to a portion of nucleobases 17853-17883 of SEQ ID NO: 2.

In certain embodiments, modified oligonucleotides complementary to a portion of nucleobases 17853-17883 of SEQ ID NO: 2 achieve at least 65% reduction of PLP1 RNA in the standard in vitro assay. In certain embodiments, modified oligonucleotides complementary to a portion of nucleobases 17853-17883 of SEQ ID NO: 2 achieve an average of 73.5% reduction of PLP1 RNA in the standard in vitro assay.

8. Nucleobases 18097-18160 of SEQ ID NO: 2

In certain embodiments, nucleobases 18097-18160 of SEQ ID NO: 2 comprise a hotspot region. In certain embodiments, modified oligonucleotides are complementary to a portion of nucleobases 18097-18160 of SEQ ID NO: 2. In certain embodiments, modified oligonucleotides are 20 nucleobases in length. In certain embodiments, modified oligonucleotides are 18 nucleobases in length. In certain embodiments, modified oligonucleotides are 16, 17, 18, 19, 20, 21, or 22 nucleobases in length. In certain embodiments, modified oligonucleotides consist of 17-19 or 21-30 linked nucleosides. In certain embodiments, modified oligonucleotides are gapmers. In certain embodiments, the gapmers are MOE gapmers. In certain embodiments, the gapmers are 5-10-5 MOE gapmers. In certain embodiments, the gapmers are 6-10-4 MOE gapmers. In certain embodiments, the gapmers are 4-10-6 MOE gapmers. In certain embodiments, the gapmers are 4-8-6 MOE gapmers. In certain embodiments, the gapmers are 6-8-4 MOE gapmers. In certain embodiments, the gapmers are 5-8-5 MOE gapmers. In certain embodiments, the gapmers have the sugar motif in order from 5' to 3': eeeeedddddddddeeeee or eeeeeeddddddddddeeee, wherein 'd' represents a 2'-β-D-deoxyribosyl sugar moiety, and 'e' represents a 2'-MOE sugar moiety. In certain embodiments, the gapmers comprise a 2'-substituted nucleoside in the gap. In certain embodiments, the 2'-substituted nucleoside comprises a 2'-OMe sugar moiety. In certain embodiments, the 2'-substituted nucleoside is at position 2 of the gap (5' to 3').

In certain embodiments, all of the internucleoside linkages of the modified oligonucleotides are phosphorothioate internucleoside linkages. In certain embodiments, the internucleoside linkages of the modified oligonucleotides are phosphorothioate internucleoside linkages and phosphodiester internucleoside linkages. In certain embodiments, the phosphodiester ("o") and phosphorothioate ("s") internucleoside linkages are arranged in the order from 5' to 3': sooosssssssssssooss or soooossssssssssssoss, wherein each "s" represents a phosphorothioate internucleoside linkage and each "o" represents a phosphodiester internucleoside linkage.

The nucleobase sequences of SEQ ID NOs: 200, 420, 504, 620, 646, 709, 823, 980, 1029, 1149, 1196, 1253, 1323, 1423, 1476, 1605, 1613, 1728, and 1832 are complementary to a portion of nucleobases 18097-18160 of SEQ ID NO: 2.

The nucleobase sequences of Compound Nos.: 1218175, 1362441, 1362447, 1362750, 1362769, 1362774, 1362926, 1362945, 1362957, 1362963, 1362967, 1363191, 1363253, 1363427, 1363489, 1363691, 1363993, 1364083, 1364097, and 1364099 are complementary to a portion of nucleobases 18097-18160 of SEQ ID NO: 2.

In certain embodiments, modified oligonucleotides complementary to a portion of nucleobases 18097-18160 of SEQ ID NO: 2 achieve at least 53% reduction of PLP1 RNA in the standard in vitro assay. In certain embodiments, modified oligonucleotides complementary to a portion of nucleobases 18097-18160 of SEQ ID NO: 2 achieve an average of 70.1% reduction of PLP1 RNA in the standard in vitro assay.

9. Nucleobases 18206-18237 of SEQ ID NO: 2

In certain embodiments, nucleobases 18206-18237 of SEQ ID NO: 2 comprise a hotspot region. In certain embodiments, modified oligonucleotides are complementary to a portion of nucleobases 18206-18237 of SEQ ID NO: 2. In certain embodiments, modified oligonucleotides are 20 nucleobases in length. In certain embodiments, modified oligonucleotides are 18 nucleobases in length. In certain embodiments, modified oligonucleotides are 16, 17, 18, 19, 20, 21, or 22 nucleobases in length. In certain embodiments, modified oligonucleotides consist of 17-19 or 21-30 linked nucleosides. In certain embodiments, modified oligonucleotides are gapmers. In certain embodiments, the gapmers are MOE gapmers. In certain embodiments, the gapmers are 5-10-5 MOE gapmers. In certain embodiments, the gapmers are 6-10-4 MOE gapmers. In certain embodiments, the gapmers are 4-10-6 MOE gapmers. In certain embodiments, the gapmers are 4-8-6 MOE gapmers. In certain embodiments, the gapmers are 6-8-4 MOE gapmers. In certain embodiments, the gapmers are 5-8-5 MOE gapmers. In certain embodiments, the gapmers have the sugar motif in order from 5' to 3': eeeeedddddddddeeeee or eeeeeeddddddddddeeee, wherein 'd' represents a 2'-β-D-deoxyribosyl sugar moiety, and 'e' represents a 2'-MOE sugar moiety. In certain embodiments, the gapmers comprise a 2'-substituted nucleoside in the gap. In certain embodiments, the 2'-substituted nucleoside comprises a 2'-OMe sugar moiety. In certain embodiments, the 2'-substituted nucleoside is at position 2 of the gap (5' to 3').

In certain embodiments, all of the internucleoside linkages of the modified oligonucleotides are phosphorothioate internucleoside linkages. In certain embodiments, the internucleoside linkages of the modified oligonucleotides are phosphorothioate internucleoside linkages and phosphodiester internucleoside linkages. In certain embodiments, the phosphodiester ("o") and phosphorothioate ("s") internucleoside linkages are arranged in the order from 5' to 3': sooosssssssssssooss or soooossssssssssssoss, wherein each "s" represents a phosphorothioate internucleoside linkage and each "o" represents a phosphodiester internucleoside linkage.

The nucleobase sequences of 45, 46, 123, 124, 201, 202, 279, 280, 538, 562, and 2091 are complementary to a portion of nucleobases 18206-18237 of SEQ ID NO: 2.

The nucleobase sequences of Compound Nos.: 1218177, 1218178, 1218179, 1218180, 1218181, 1218182, 1218183, 1218184, 1362490, 1362584, 1362927, 1363103, 1363121, 1363314, and 1363983 are complementary to a portion of nucleobases 18206-18237 of SEQ ID NO: 2.

In certain embodiments, modified oligonucleotides complementary to a portion of nucleobases 18206-18237 of SEQ ID NO: 2 achieve at least 64% reduction of PLP1 RNA in the standard in vitro assay. In certain embodiments, modified oligonucleotides complementary to a portion of nucleobases 18206-18237 of SEQ ID NO: 2 achieve an average of 81.8% reduction of PLP1 RNA in the standard in vitro assay.

10. Nucleobases 18237-18340 of SEQ ID NO: 2

In certain embodiments, nucleobases 18237-18340 of SEQ ID NO: 2 comprise a hotspot region. In certain embodiments, modified oligonucleotides are complementary to a portion of nucleobases 18237-18340 of SEQ ID NO: 2. In certain embodiments, modified oligonucleotides are 20 nucleobases in length. In certain embodiments, modified oligonucleotides are 18 nucleobases in length. In certain embodiments, modified oligonucleotides are 16, 17, 18, 19, 20, 21, or 22 nucleobases in length. In certain embodiments, modified oligonucleotides consist of 17-19 or 21-30 linked nucleosides. In certain embodiments, modified oligonucleotides are gapmers. In certain embodiments, the gapmers are MOE gapmers. In certain embodiments, the gapmers are 5-10-5 MOE gapmers. In certain embodiments, the gapmers are 6-10-4 MOE gapmers. In certain embodiments, the gapmers are 4-10-6 MOE gapmers. In certain embodiments, the gapmers are 4-8-6 MOE gapmers. In certain embodiments, the gapmers are 6-8-4 MOE gapmers. In certain embodiments, the gapmers are 5-8-5 MOE gapmers. In certain embodiments, the gapmers have the sugar motif in order from 5' to 3': eeeeedddddddddeeeee or eeeeeedddddddddeeee, wherein 'd' represents a 2'-β-D-deoxyribosyl sugar moiety, and 'e' represents a 2'-MOE sugar moiety. In certain embodiments, the gapmers comprise a 2'-substituted nucleoside in the gap. In certain embodiments, the 2'-substituted nucleoside comprises a 2'-OMe sugar moiety. In certain embodiments, the 2'-substituted nucleoside is at position 2 of the gap (5' to 3').

In certain embodiments, all of the internucleoside linkages of the modified oligonucleotides are phosphorothioate internucleoside linkages. In certain embodiments, the internucleoside linkages of the modified oligonucleotides are phosphorothioate internucleoside linkages and phosphodiester internucleoside linkages. In certain embodiments, the phosphodiester ("o") and phosphorothioate ("s") internucleoside linkages are arranged in the order from 5' to 3': sooooossssssssssooss or soooooossssssssssoss, wherein each "s" represents a phosphorothioate internucleoside linkage and each "o" represents a phosphodiester internucleoside linkage.

The nucleobase sequences of SEQ ID NOs: 48, 49, 50, 51, 52, 53, 125, 126, 127, 128, 129, 130, 131, 203, 204, 205, 206, 207, 208, 281, 282, 283, 284, 285, 286, 414, 459, 485, 503, 579, 580, 693, 724, 840, 873, 911, 1034, 1081, 1125, 1159, 1318, 1413, 1513, 1548, 1672, 1701, 1794, 1868, 1958, and 2002 are complementary to a portion of nucleobases 18237-18340 of SEQ ID NO: 2.

The nucleobase sequences of Compound Nos.: 1218186, 1218187, 1218188, 1218189, 1218190, 1218191, 1218192, 1218193, 1218194, 1218195, 1218196, 1218197, 1218198, 1218199, 1218200, 1218201, 1218202, 1218203, 1218204, 1218205, 1218206, 1218207, 1218208, 1218209, 1218210, 1362429, 1362468, 1362571, 1362623, 1362659, 1362697, 1362699, 1362710, 1362714, 1362723, 1362734, 1362821, 1362902, 1362924, 1362955, 1362977, 1363036, 1363051, 1363069, 1363149, 1363206, 1363269, 1363286, 1363355, 1363429, 1363518, 1363687, 1363748, 1363790, 1363856, 1363872, 1363884, 1364129, 1364227, and 1364246 are complementary to a portion of nucleobases 18237-18340 of SEQ ID NO: 2.

In certain embodiments, modified oligonucleotides complementary to a portion of nucleobases 18237-18340 of SEQ ID NO: 2 achieve at least 44% reduction of PLP1 RNA in the standard in vitro assay. In certain embodiments, modified oligonucleotides complementary to a portion of nucleobases 18237-18340 of SEQ ID NO: 2 achieve an average of 70.9% reduction of PLP1 RNA in the standard in vitro assay.

11. Nucleobases 18350-18387 of SEQ ID NO: 2

In certain embodiments, nucleobases 18350-18387 of SEQ ID NO: 2 comprise a hotspot region. In certain embodiments, modified oligonucleotides are complementary to a portion of nucleobases 18350-18387 of SEQ ID NO: 2. In certain embodiments, modified oligonucleotides are 20 nucleobases in length. In certain embodiments, modified oligonucleotides are 18 nucleobases in length. In certain embodiments, modified oligonucleotides are 16, 17, 18, 19, 20, 21, or 22 nucleobases in length. In certain embodiments, modified oligonucleotides consist of 17-19 or 21-30 linked nucleosides. In certain embodiments, modified oligonucleotides are gapmers. In certain embodiments, the gapmers are MOE gapmers. In certain embodiments, the gapmers are 5-10-5 MOE gapmers. In certain embodiments, the gapmers are 6-10-4 MOE gapmers. In certain embodiments, the gapmers are 4-10-6 MOE gapmers. In certain embodiments, the gapmers are 4-8-6 MOE gapmers. In certain embodiments, the gapmers are 6-8-4 MOE gapmers. In certain embodiments, the gapmers are 5-8-5 MOE gapmers. In certain embodiments, the gapmers have the sugar motif in order from 5' to 3': eeeeedddddddddeeeee or eeeeeedddddddddeeee, wherein 'd' represents a 2'-β-D-deoxyribosyl sugar moiety, and 'e' represents a 2'-MOE sugar moiety. In certain embodiments, the gapmers comprise a 2'-substituted nucleoside in the gap. In certain embodiments, the 2'-substituted nucleoside comprises a 2'-OMe sugar moiety. In certain embodiments, the 2'-substituted nucleoside is at position 2 of the gap (5' to 3').

In certain embodiments, all of the internucleoside linkages of the modified oligonucleotides are phosphorothioate internucleoside linkages. In certain embodiments, the internucleoside linkages of the modified oligonucleotides are phosphorothioate internucleoside linkages and phosphodiester internucleoside linkages. In certain embodiments, the phosphodiester ("o") and phosphorothioate ("s") internucleoside linkages are arranged in the order from 5' to 3': sooooossssssssssooss or soooooossssssssssoss, wherein each "s" represents a phosphorothioate internucleoside linkage and each "o" represents a phosphodiester internucleoside linkage.

The nucleobase sequences of SEQ ID NOs: 209, 287, 335, 439, 506, 606, 659, 1922, 2033, and 2104 are complementary to a portion of nucleobases 18350-18387 of SEQ ID NO: 2.

The nucleobase sequences of Compound Nos.: 1218211, 1218212, 1362567, 1362579, 1362987, 1363166, 1363184, 1363310, 1363502, and 1363644 are complementary to a portion of nucleobases 18350-18387 of SEQ ID NO: 2.

In certain embodiments, modified oligonucleotides complementary to a portion of nucleobases 18350-18387 of SEQ ID NO: 2 achieve at least 64% reduction of PLP1 RNA in the standard in vitro assay. In certain embodiments, modified oligonucleotides complementary to a portion of nucleobases 18350-18387 of SEQ ID NO: 2 achieve an average of 76.2% reduction of PLP1 RNA in the standard in vitro assay.

12. Nucleobases 18412-18469 of SEQ ID NO: 2

In certain embodiments, nucleobases 18412-18469 of SEQ ID NO: 2 comprise a hotspot region. In certain embodiments, modified oligonucleotides are complementary to a portion of nucleobases 18412-18469 of SEQ ID NO: 2. In certain embodiments, modified oligonucleotides are 20 nucleobases in length. In certain embodiments, modified oligonucleotides are 18 nucleobases in length. In certain embodiments, modified oligonucleotides are 16, 17, 18, 19, 20, 21, or 22 nucleobases in length. In certain embodiments, modified oligonucleotides consist of 17-19 or 21-30 linked nucleosides. In certain embodiments, modified oligonucleotides are gapmers. In certain embodiments, the gapmers are MOE gapmers. In certain embodiments, the gapmers are 5-10-5 MOE gapmers. In certain embodiments, the gapmers are 6-10-4 MOE gapmers. In certain embodiments, the gapmers are 4-10-6 MOE gapmers. In certain embodiments, the gapmers are 4-8-6 MOE gapmers. In certain embodiments, the gapmers are 6-8-4 MOE gapmers. In certain embodiments, the gapmers are 5-8-5 MOE gapmers. In certain embodiments, the gapmers have the sugar motif in order from 5' to 3': eeeeedddddddddeeeee or eeeeeedddddddddeeee, wherein 'd' represents a 2'-β-D-deoxyribosyl sugar moiety, and 'e' represents a 2'-MOE sugar moiety. In certain embodiments, the gapmers comprise a 2'-substituted nucleoside in the gap. In certain embodiments, the 2'-substituted nucleoside comprises a 2'-OMe sugar moiety. In certain embodiments, the 2'-substituted nucleoside is at position 2 of the gap (5' to 3').

In certain embodiments, all of the internucleoside linkages of the modified oligonucleotides are phosphorothioate internucleoside linkages. In certain embodiments, the internucleoside linkages of the modified oligonucleotides are phosphorothioate internucleoside linkages and phosphodiester internucleoside linkages. In certain embodiments, the phosphodiester ("o") and phosphorothioate ("s") internucleoside linkages are arranged in the order from 5' to 3': sooooossssssssssooss or soooooossssssssssoss, wherein each "s" represents a phosphorothioate internucleoside linkage and each "o" represents a phosphodiester internucleoside linkage.

The nucleobase sequences of SEQ ID NOs: 784, 842, 869, 978, 1082, 1131, 1218, 1250, 1320, 1453, 1529, 1538, 1616, 1712, and 1821 are complementary to a portion of nucleobases 18412-18469 of SEQ ID NO: 2.

The nucleobase sequences of Compound Nos.: 1362519, 1362535, 1362684, 1362724, 1362885, 1363026, 1363457, 1363648, 1363838, 1363887, 1363933, 1364125, 1364192, 1364197, and 1364255 are complementary to a portion of nucleobases 18412-18469 of SEQ ID NO: 2.

In certain embodiments, modified oligonucleotides complementary to a portion of nucleobases 18412-18469 of SEQ ID NO: 2 achieve at least 67% reduction of PLP1 RNA in the standard in vitro assay. In certain embodiments, modified oligonucleotides complementary to a portion of nucleobases 18412-18469 of SEQ ID NO: 2 achieve an average of 75% reduction of PLP1 RNA in the standard in vitro assay.

13. Nucleobases 18461-18506 of SEQ ID NO: 2

In certain embodiments, nucleobases 18461-18506 of SEQ ID NO: 2 comprise a hotspot region. In certain embodiments, modified oligonucleotides are complementary to a portion of nucleobases 18461-18506 of SEQ ID NO: 2. In certain embodiments, modified oligonucleotides are 20 nucleobases in length. In certain embodiments, modified oligonucleotides are 18 nucleobases in length. In certain embodiments, modified oligonucleotides are 16, 17, 18, 19, 20, 21, or 22 nucleobases in length. In certain embodiments, modified oligonucleotides consist of 17-19 or 21-30 linked nucleosides. In certain embodiments, modified oligonucleotides are gapmers. In certain embodiments, the gapmers are MOE gapmers. In certain embodiments, the gapmers are 5-10-5 MOE gapmers. In certain embodiments, the gapmers are 6-10-4 MOE gapmers. In certain embodiments, the gapmers are 4-10-6 MOE gapmers. In certain embodiments, the gapmers are 4-8-6 MOE gapmers. In certain embodiments, the gapmers are 6-8-4 MOE gapmers. In certain embodiments, the gapmers are 5-8-5 MOE gapmers. In certain embodiments, the gapmers have the sugar motif in order from 5' to 3': eeeeeddddddddddeeeee or eeeeeedddddddddddeeee, wherein 'd' represents a 2'-β-D-deoxyribosyl sugar moiety, and 'e' represents a 2'-MOE sugar moiety. In certain embodiments, the gapmers comprise a 2'-substituted nucleoside in the gap. In certain embodiments, the 2'-substituted nucleoside comprises a 2'-OMe sugar moiety. In certain embodiments, the 2'-substituted nucleoside is at position 2 of the gap (5' to 3').

In certain embodiments, all of the internucleoside linkages of the modified oligonucleotides are phosphorothioate internucleoside linkages. In certain embodiments, the internucleoside linkages of the modified oligonucleotides are phosphorothioate internucleoside linkages and phosphodiester internucleoside linkages. In certain embodiments, the phosphodiester ("o") and phosphorothioate ("s") internucleoside linkages are arranged in the order from 5' to 3': sooooossssssssssooss or soooooossssssssssoss, wherein each "s" represents a phosphorothioate internucleoside linkage and each "o" represents a phosphodiester internucleoside linkage.

The nucleobase sequences of SEQ ID NOs: 54, 55, 132, 133, 210, 288, 419, 499, 564, 665, 764, 800, 881, 993, 1059, 1200, 1295, 1354, 1422, 1465, 1544, 1705, 1802, and 2149 are complementary to a portion of nucleobases 18461-18506 of SEQ ID NO: 2.

The nucleobase sequences of Compound Nos.: 1218213, 1218214, 1218215, 1218216, 1218217, 1218218, 1362618, 1362620, 1362632, 1362704, 1362718, 1362815, 1363013, 1363023, 1363128, 1363328, 1363400, 1363431, 1363519, 1363533, 1363570, 1363709, 1363762, 1363975, 1364180, 1523591, 1523592, and 1523593 are complementary to a portion of nucleobases 18461-18506 of SEQ ID NO: 2.

In certain embodiments, modified oligonucleotides complementary to a portion of nucleobases 18461-18506 of SEQ ID NO: 2 achieve at least 40% reduction of PLP1 RNA in the standard in vitro assay. In certain embodiments, modified oligonucleotides complementary to a portion of nucleobases 18461-18506 of SEQ ID NO: 2 achieve an average of 69.7% reduction of PLP1 RNA in the standard in vitro assay.

14. Nucleobases 18539-18579 of SEQ ID NO: 2

In certain embodiments, nucleobases 18539-18579 of SEQ ID NO: 2 comprise a hotspot region. In certain embodiments, modified oligonucleotides are complementary to a portion of nucleobases 18539-18579 of SEQ ID NO: 2.

In certain embodiments, modified oligonucleotides are 20 nucleobases in length. In certain embodiments, modified oligonucleotides are 18 nucleobases in length. In certain embodiments, modified oligonucleotides are 16, 17, 18, 19, 20, 21, or 22 nucleobases in length. In certain embodiments, modified oligonucleotides consist of 17-19 or 21-30 linked nucleosides. In certain embodiments, modified oligonucleotides are gapmers. In certain embodiments, the gapmers are MOE gapmers. In certain embodiments, the gapmers are 5-10-5 MOE gapmers. In certain embodiments, the gapmers are 6-10-4 MOE gapmers. In certain embodiments, the gapmers are 4-10-6 MOE gapmers. In certain embodiments, the gapmers are 4-8-6 MOE gapmers. In certain embodiments, the gapmers are 6-8-4 MOE gapmers. In certain embodiments, the gapmers are 5-8-5 MOE gapmers. In certain embodiments, the gapmers have the sugar motif in order from 5' to 3': eeeeeddddddddddeeeee or eeeeeedddddddddddeeee, wherein 'd' represents a 2'-β-D-deoxyribosyl sugar moiety, and 'e' represents a 2'-MOE sugar moiety. In certain embodiments, the gapmers comprise a 2'-substituted nucleoside in the gap. In certain embodiments, the 2'-substituted nucleoside comprises a 2'-OMe sugar moiety. In certain embodiments, the 2'-substituted nucleoside is at position 2 of the gap (5' to 3').

In certain embodiments, all of the internucleoside linkages of the modified oligonucleotides are phosphorothioate internucleoside linkages. In certain embodiments, the internucleoside linkages of the modified oligonucleotides are phosphorothioate internucleoside linkages and phosphodiester internucleoside linkages. In certain embodiments, the phosphodiester ("o") and phosphorothioate ("s") internucleoside linkages are arranged in the order from 5' to 3': sooooossssssssssooss or soooooossssssssssoss, wherein each "s" represents a phosphorothioate internucleoside linkage and each "o" represents a phosphodiester internucleoside linkage.

The nucleobase sequences of SEQ ID NOs: 338, 438, 525, 604, 658, 758, 813, 887, 977, 1043, 1108, 1199, 1258, 1336, 1395, 1514, 1557, 1668, 1697, and 2089 are complementary to a portion of nucleobases 18539-18579 of SEQ ID NO: 2.

The nucleobase sequences of Compound Nos.: 1362619, 1362637, 1362652, 1362830, 1362901, 1363079, 1363118, 1363143, 1363145, 1363146, 1363176, 1363193, 1363287, 1363422, 1363451, 1363569, 1363592, 1363611, 1363796, and 1363860 are complementary to a portion of nucleobases 18539-18579 of SEQ ID NO: 2.

In certain embodiments, modified oligonucleotides complementary to a portion of nucleobases 18539-18579 of SEQ ID NO: 2 achieve at least 62% reduction of PLP1 RNA in the standard in vitro assay. In certain embodiments, modified oligonucleotides complementary to a portion of nucleobases 18539-18579 of SEQ ID NO: 2 achieve an average of 68.8% reduction of PLP1 RNA in the standard in vitro assay.

15. Nucleobases 18697-18727 of SEQ ID NO: 2

In certain embodiments, nucleobases 18697-18727 of SEQ ID NO: 2 comprise a hotspot region. In certain embodiments, modified oligonucleotides are complementary to a portion of nucleobases 18697-18727 of SEQ ID NO: 2.

In certain embodiments, modified oligonucleotides are 20 nucleobases in length. In certain embodiments, modified oligonucleotides are 18 nucleobases in length. In certain embodiments, modified oligonucleotides are 16, 17, 18, 19, 20, 21, or 22 nucleobases in length. In certain embodiments, modified oligonucleotides consist of 17-19 or 21-30 linked nucleosides. In certain embodiments, modified oligonucleotides are gapmers. In certain embodiments, the gapmers are MOE gapmers. In certain embodiments, the gapmers are 5-10-5 MOE gapmers. In certain embodiments, the gapmers are 6-10-4 MOE gapmers. In certain embodiments, the gapmers are 4-10-6 MOE gapmers. In certain embodiments, the gapmers are 4-8-6 MOE gapmers. In certain embodiments, the gapmers are 6-8-4 MOE gapmers. In certain embodiments, the gapmers are 5-8-5 MOE gapmers. In certain embodiments, the gapmers have the sugar motif in order from 5' to 3': eeeeeddddddddddeeeee or eeeeeeddddddddddeeee, wherein 'd' represents a 2'-β-D-deoxyribosyl sugar moiety, and 'e' represents a 2'-MOE sugar moiety. In certain embodiments, the gapmers comprise a 2'-substituted nucleoside in the gap. In certain embodiments, the 2'-substituted nucleoside comprises a 2'-OMe sugar moiety. In certain embodiments, the 2'-substituted nucleoside is at position 2 of the gap (5' to 3').

In certain embodiments, all of the internucleoside linkages of the modified oligonucleotides are phosphorothioate internucleoside linkages. In certain embodiments, the internucleoside linkages of the modified oligonucleotides are phosphorothioate internucleoside linkages and phosphodiester internucleoside linkages. In certain embodiments, the phosphodiester ("o") and phosphorothioate ("s") internucleoside linkages are arranged in the order from 5' to 3': sooosssssssssssooss or soooosssssssssssoss, wherein each "s" represents a phosphorothioate internucleoside linkage and each "o" represents a phosphodiester internucleoside linkage.

The nucleobase sequences of SEQ ID NOs: 875, 934, 1047, 1110, 1229, 1243, 1373, 1438, 2146, and 2147 are complementary to a portion of nucleobases 18697-18727 of SEQ ID NO: 2.

The nucleobase sequences of Compound Nos.: 1362458, 1362696, 1362878, 1363179, 1363351, 1363697, 1364107, 1364147, 1523584, 1523586, and 1523587 are complementary to a portion of nucleobases 18697-18727 of SEQ ID NO: 2.

In certain embodiments, modified oligonucleotides complementary to a portion of nucleobases 18697-18727 of SEQ ID NO: 2 achieve at least 66% reduction of PLP1 RNA in the standard in vitro assay. In certain embodiments, modified oligonucleotides complementary to a portion of nucleobases 18697-18727 of SEQ ID NO: 2 achieve an average of 77.7% reduction of PLP1 RNA in the standard in vitro assay.

16. Nucleobases 18755-18793 of SEQ ID NO: 2

In certain embodiments, nucleobases 18755-18793 of SEQ ID NO: 2 comprise a hotspot region. In certain embodiments, modified oligonucleotides are complementary to a portion of nucleobases 18755-18793 of SEQ ID NO: 2. In certain embodiments, modified oligonucleotides are 20 nucleobases in length. In certain embodiments, modified oligonucleotides are 18 nucleobases in length. In certain embodiments, modified oligonucleotides are 16, 17, 18, 19, 20, 21, or 22 nucleobases in length. In certain embodiments, modified oligonucleotides consist of 17-19 or 21-30 linked nucleosides. In certain embodiments, modified oligonucleotides are gapmers. In certain embodiments, the gapmers are MOE gapmers. In certain embodiments, the gapmers are 5-10-5 MOE gapmers. In certain embodiments, the gapmers are 6-10-4 MOE gapmers. In certain embodiments, the gapmers are 4-10-6 MOE gapmers. In certain embodiments, the gapmers are 4-8-6 MOE gapmers. In certain embodiments, the gapmers are 6-8-4 MOE gapmers. In certain embodiments, the gapmers are 5-8-5 MOE gapmers. In certain embodiments, the gapmers have the sugar motif in order from 5' to 3': eeeeeddddddddddeeeee or eeeeeeddddddddddeeee, wherein 'd' represents a 2'-β-D-deoxyribosyl sugar moiety, and 'e' represents a 2'-MOE sugar moiety. In certain embodiments, the gapmers comprise a 2'-substituted nucleoside in the gap. In certain embodiments, the 2'-substituted nucleoside comprises a 2'-OMe sugar moiety. In certain embodiments, the 2'-substituted nucleoside is at position 2 of the gap (5' to 3').

In certain embodiments, all of the internucleoside linkages of the modified oligonucleotides are phosphorothioate internucleoside linkages. In certain embodiments, the internucleoside linkages of the modified oligonucleotides are phosphorothioate internucleoside linkages and phosphodiester internucleoside linkages. In certain embodiments, the phosphodiester ("o") and phosphorothioate ("s") internucleoside linkages are arranged in the order from 5' to 3': sooosssssssssssooss or soooosssssssssssoss, wherein each "s" represents a phosphorothioate internucleoside linkage and each "o" represents a phosphodiester internucleoside linkage.

The nucleobase sequences of SEQ ID NOs: 761, 798, 890, 946, 1022, 1120, 1198, 1293, 1358, 1398, and 1463 are complementary to a portion of nucleobases 18755-18793 of SEQ ID NO: 2.

The nucleobase sequences of Compound Nos.: 1362575, 1362680, 1362689, 1362856, 1363019, 1363172, 1363357, 1363391, 1363591, 1363639, and 1363889 are complementary to a portion of nucleobases 18755-18793 of SEQ ID NO: 2.

In certain embodiments, modified oligonucleotides complementary to a portion of nucleobases 18755-18793 of SEQ ID NO: 2 achieve at least 65% reduction of PLP1 RNA in the standard in vitro assay. In certain embodiments, modified oligonucleotides complementary to a portion of nucleobases 18755-18793 of SEQ ID NO: 2 achieve an average of 77.7% reduction of PLP1 RNA in the standard in vitro assay.

17. Nucleobases 18797-18819 of SEQ ID NO: 2

In certain embodiments, nucleobases 18797-18819 of SEQ ID NO: 2 comprise a hotspot region. In certain embodiments, modified oligonucleotides are complementary to a portion of nucleobases 18797-18819 of SEQ ID NO: 2. In certain embodiments, modified oligonucleotides are 20 nucleobases in length. In certain embodiments, modified oligonucleotides are 18 nucleobases in length. In certain embodiments, modified oligonucleotides are 16, 17, 18, 19, 20, 21, or 22 nucleobases in length. In certain embodiments, modified oligonucleotides consist of 17-19 or 21-30 linked nucleosides. In certain embodiments, modified oligonucleotides are gapmers. In certain embodiments, the gapmers are MOE gapmers. In certain embodiments, the gapmers are 5-10-5 MOE gapmers. In certain embodiments, the gapmers are 6-10-4 MOE gapmers. In certain embodiments, the gapmers are 4-10-6 MOE gapmers. In certain embodiments, the gapmers are 4-8-6 MOE gapmers. In certain embodiments, the gapmers are 6-8-4 MOE gapmers. In certain embodiments, the gapmers are 5-8-5 MOE gapmers. In certain embodiments, the gapmers have the sugar motif in order from 5' to 3': eeeeedddddddddeeeee or eeeeeedddddddddeeee, wherein 'd' represents a 2'-β-D-deoxyribosyl sugar moiety, and 'e' represents a 2'-MOE sugar moiety. In certain embodiments, the gapmers comprise a 2'-substituted nucleoside in the gap. In certain embodiments, the 2'-substituted nucleoside comprises a 2'-OMe sugar moiety. In certain embodiments, the 2'-substituted nucleoside is at position 2 of the gap (5' to 3').

In certain embodiments, all of the internucleoside linkages of the modified oligonucleotides are phosphorothioate internucleoside linkages. In certain embodiments, the internucleoside linkages of the modified oligonucleotides are phosphorothioate internucleoside linkages and phosphodiester internucleoside linkages. In certain embodiments, the phosphodiester ("o") and phosphorothioate ("s") internucleoside linkages are arranged in the order from 5' to 3': sooosssssssssssooss or soooossssssssssoss, wherein each "s" represents a phosphorothioate internucleoside linkage and each "o" represents a phosphodiester internucleoside linkage.

The nucleobase sequences of SEQ ID NOs: 56, 134, 683, and 718 are complementary to a portion of nucleobases 18797-18819 of SEQ ID NO: 2.

The nucleobase sequences of Compound Nos.: 1218221, 1218222, 1362445, 1362612, 1363487, and 1363656 are complementary to a portion of nucleobases 18797-18819 of SEQ ID NO: 2.

In certain embodiments, modified oligonucleotides complementary to a portion of nucleobases 18797-18819 of SEQ ID NO: 2 achieve at least 65% reduction of PLP1 RNA in the standard in vitro assay. In certain embodiments, modified oligonucleotides complementary to a portion of nucleobases 18797-18819 of SEQ ID NO: 2 achieve an average of 75.4% reduction of PLP1 RNA in the standard in vitro assay.

18. Nucleobases 18839-18862 of SEQ ID NO: 2

In certain embodiments, nucleobases 18839-18862 of SEQ ID NO: 2 comprise a hotspot region. In certain embodiments, modified oligonucleotides are complementary to a portion of nucleobases 18839-18862 of SEQ ID NO: 2. In certain embodiments, modified oligonucleotides are 20 nucleobases in length. In certain embodiments, modified oligonucleotides are 18 nucleobases in length. In certain embodiments, modified oligonucleotides are 16, 17, 18, 19, 20, 21, or 22 nucleobases in length. In certain embodiments, modified oligonucleotides consist of 17-19 or 21-30 linked nucleosides. In certain embodiments, modified oligonucleotides are gapmers. In certain embodiments, the gapmers are MOE gapmers. In certain embodiments, the gapmers are 5-10-5 MOE gapmers. In certain embodiments, the gapmers are 6-10-4 MOE gapmers. In certain embodiments, the gapmers are 4-10-6 MOE gapmers. In certain embodiments, the gapmers are 4-8-6 MOE gapmers. In certain embodiments, the gapmers are 6-8-4 MOE gapmers. In certain embodiments, the gapmers are 5-8-5 MOE gapmers. In certain embodiments, the gapmers have the sugar motif in order from 5' to 3': eeeeedddddddddeeeee or eeeeeedddddddddeeee, wherein 'd' represents a 2'-β-D-deoxyribosyl sugar moiety, and 'e' represents a 2'-MOE sugar moiety. In certain embodiments, the gapmers comprise a 2'-substituted nucleoside in the gap. In certain embodiments, the 2'-substituted nucleoside comprises a 2'-OMe sugar moiety. In certain embodiments, the 2'-substituted nucleoside is at position 2 of the gap (5' to 3').

In certain embodiments, all of the internucleoside linkages of the modified oligonucleotides are phosphorothioate internucleoside linkages. In certain embodiments, the internucleoside linkages of the modified oligonucleotides are phosphorothioate internucleoside linkages and phosphodiester internucleoside linkages. In certain embodiments, the phosphodiester ("o") and phosphorothioate ("s") internucleoside linkages are arranged in the order from 5' to 3': sooosssssssssssooss or soooossssssssssoss, wherein each "s" represents a phosphorothioate internucleoside linkage and each "o" represents a phosphodiester internucleoside linkage.

The nucleobase sequences of SEQ ID NOs: 1610, 1663, 1702, and 1786 are complementary to a portion of nucleobases 18839-18862 of SEQ ID NO: 2.

The nucleobase sequences of Compound Nos.: 1363076, 1362712, 1363649, and 1364195 are complementary to a portion of nucleobases 18839-18862 of SEQ ID NO: 2.

In certain embodiments, modified oligonucleotides complementary to a portion of nucleobases 18839-18862 of SEQ ID NO: 2 achieve at least 66% reduction of PLP1 RNA in the standard in vitro assay. In certain embodiments, modified oligonucleotides complementary to a portion of nucleobases 18839-18862 of SEQ ID NO: 2 achieve an average of 72.8% reduction of PLP1 RNA in the standard in vitro assay.

19. Nucleobases 18974-19021 of SEQ ID NO: 2

In certain embodiments, nucleobases 18974-19021 of SEQ ID NO: 2 comprise a hotspot region. In certain embodiments, modified oligonucleotides are complementary to a portion of nucleobases 18974-19021 of SEQ ID NO: 2. In certain embodiments, modified oligonucleotides are 20 nucleobases in length. In certain embodiments, modified oligonucleotides are 18 nucleobases in length. In certain embodiments, modified oligonucleotides are 16, 17, 18, 19, 20, 21, or 22 nucleobases in length. In certain embodiments, modified oligonucleotides consist of 17-19 or 21-30 linked nucleosides. In certain embodiments, modified oligonucleotides are gapmers. In certain embodiments, the gapmers are MOE gapmers. In certain embodiments, the gapmers are 5-10-5 MOE gapmers. In certain embodiments, the gapmers are 6-10-4 MOE gapmers. In certain embodiments, the gapmers are 4-10-6 MOE gapmers. In certain embodiments, the gapmers are 4-8-6 MOE gapmers. In certain embodiments, the gapmers are 6-8-4 MOE gapmers. In certain embodiments, the gapmers are 5-8-5 MOE gapmers. In certain embodiments, the gapmers have the sugar motif in order from 5' to 3': eeeeeddddddddddeeeee or eeeeeedddddddddddeeee, wherein 'd' represents a 2'-β-D-deoxyribosyl sugar moiety, and 'e' represents a 2'-MOE sugar moiety. In certain embodiments, the gapmers comprise a 2'-substituted nucleoside in the gap. In certain embodiments, the 2'-substituted nucleoside comprises a 2'-OMe sugar moiety. In certain embodiments, the 2'-substituted nucleoside is at position 2 of the gap (5' to 3').

In certain embodiments, all of the internucleoside linkages of the modified oligonucleotides are phosphorothioate internucleoside linkages. In certain embodiments, the internucleoside linkages of the modified oligonucleotides are phosphorothioate internucleoside linkages and phosphodiester internucleoside linkages. In certain embodiments, the phosphodiester ("o") and phosphorothioate ("s") internucleoside linkages are arranged in the order from 5' to 3': sooooossssssssssooss or soooooosssssssssssoss, wherein each "s" represents a phosphorothioate internucleoside linkage and each "o" represents a phosphodiester internucleoside linkage.

The nucleobase sequences of SEQ ID NOs: 212, 1060, 1090, 1181, 1277, 1446, 1510, 1589, 1646, 1693, 1772, and 2148 are complementary to a portion of nucleobases 18974-19021 of SEQ ID NO: 2.

The nucleobase sequences of Compound Nos.: 1218223, 1362460, 1362600, 1362805, 1362892, 1363007, 1363316, 1363581, 1363642, 1363664, 1363773, 1363984, 1523588, 1523589, and 1523590 are complementary to a portion of nucleobases 18974-19021 of SEQ ID NO: 2.

In certain embodiments, modified oligonucleotides complementary to a portion of nucleobases 18974-19021 of SEQ ID NO: 2 achieve at least 54% reduction of PLP1 RNA in the standard in vitro assay. In certain embodiments, modified oligonucleotides complementary to a portion of nucleobases 18974-19021 of SEQ ID NO: 2 achieve an average of 71.5% reduction of PLP1 RNA in the standard in vitro assay.

20. Nucleobases 19028-19080 of SEQ ID NO: 2

In certain embodiments, nucleobases 19028-19080 of SEQ ID NO: 2 comprise a hotspot region. In certain embodiments, modified oligonucleotides are complementary to a portion of nucleobases 19028-19080 of SEQ ID NO: 2. In certain embodiments, modified oligonucleotides are 20 nucleobases in length. In certain embodiments, modified oligonucleotides are 18 nucleobases in length. In certain embodiments, modified oligonucleotides are 16, 17, 18, 19, 20, 21, or 22 nucleobases in length. In certain embodiments, modified oligonucleotides consist of 17-19 or 21-30 linked nucleosides. In certain embodiments, modified oligonucleotides are gapmers. In certain embodiments, the gapmers are MOE gapmers. In certain embodiments, the gapmers are 5-10-5 MOE gapmers. In certain embodiments, the gapmers are 6-10-4 MOE gapmers. In certain embodiments, the gapmers are 4-10-6 MOE gapmers. In certain embodiments, the gapmers are 4-8-6 MOE gapmers. In certain embodiments, the gapmers are 6-8-4 MOE gapmers. In certain embodiments, the gapmers are 5-8-5 MOE gapmers. In certain embodiments, the gapmers have the sugar motif in order from 5' to 3': eeeeeddddddddddeeeee or eeeeeedddddddddddeeee, wherein 'd' represents a 2'-β-D-deoxyribosyl sugar moiety, and 'e' represents a 2'-MOE sugar moiety. In certain embodiments, the gapmers comprise a 2'-substituted nucleoside in the gap. In certain embodiments, the 2'-substituted nucleoside comprises a 2'-OMe sugar moiety. In certain embodiments, the 2'-substituted nucleoside is at position 2 of the gap (5' to 3').

In certain embodiments, all of the internucleoside linkages of the modified oligonucleotides are phosphorothioate internucleoside linkages. In certain embodiments, the internucleoside linkages of the modified oligonucleotides are phosphorothioate internucleoside linkages and phosphodiester internucleoside linkages. In certain embodiments, the phosphodiester ("o") and phosphorothioate ("s") internucleoside linkages are arranged in the order from 5' to 3': sooooossssssssssooss or soooooosssssssssssoss, wherein each "s" represents a phosphorothioate internucleoside linkage and each "o" represents a phosphodiester internucleoside linkage.

The nucleobase sequences of SEQ ID NOs: 57, 586, 666, 714, 812, 914, 951, 1052, 1138, 1162, 1248, 1363, and 1455 are complementary to a portion of nucleobases 19028-19080 of SEQ ID NO: 2.

The nucleobase sequences of Compound Nos.: 1218225, 1362492, 1362565, 1362817, 1362846, 1363141, 1363160, 1363346, 1363453, 1363550, 1363765, 1363835, 1363883, and 1364201 are complementary to a portion of nucleobases 19028-19080 of SEQ ID NO: 2.

In certain embodiments, modified oligonucleotides complementary to a portion of nucleobases 19028-19080 of SEQ ID NO: 2 achieve at least 58% reduction of PLP1 RNA in the standard in vitro assay. In certain embodiments, modified oligonucleotides complementary to a portion of nucleobases 19028-19080 of SEQ ID NO: 2 achieve an average of 73.5% reduction of PLP1 RNA in the standard in vitro assay.

21. Nucleobases 19146-19173 of SEQ ID NO: 2

In certain embodiments, nucleobases 19146-19173 of SEQ ID NO: 2 comprise a hotspot region. In certain embodiments, modified oligonucleotides are complementary to a portion of nucleobases 19146-19173 of SEQ ID NO: 2.

In certain embodiments, modified oligonucleotides are 20 nucleobases in length. In certain embodiments, modified oligonucleotides are 18 nucleobases in length. In certain embodiments, modified oligonucleotides are 16, 17, 18, 19, 20, 21, or 22 nucleobases in length. In certain embodiments, modified oligonucleotides consist of 17-19 or 21-30 linked nucleosides. In certain embodiments, modified oligonucleotides are gapmers. In certain embodiments, the gapmers are MOE gapmers. In certain embodiments, the gapmers are 5-10-5 MOE gapmers. In certain embodiments, the gapmers are 6-10-4 MOE gapmers. In certain embodiments, the gapmers are 4-10-6 MOE gapmers. In certain embodiments, the gapmers are 4-8-6 MOE gapmers. In certain embodiments, the gapmers are 6-8-4 MOE gapmers. In certain embodiments, the gapmers are 5-8-5 MOE gapmers. In certain embodiments, the gapmers have the sugar motif in order from 5' to 3': eeeeeddddddddddeeeee or eeeeeedddddddddddeeee, wherein 'd' represents a 2'-β-D-deoxyribosyl sugar moiety, and 'e' represents a 2'-MOE sugar moiety. In certain embodiments, the gapmers comprise a 2'-substituted nucleoside in the gap. In certain embodiments, the 2'-substituted nucleoside comprises a 2'-OMe sugar moiety. In certain embodiments, the 2'-substituted nucleoside is at position 2 of the gap (5' to 3').

In certain embodiments, all of the internucleoside linkages of the modified oligonucleotides are phosphorothioate internucleoside linkages. In certain embodiments, the internucleoside linkages of the modified oligonucleotides are phosphorothioate internucleoside linkages and phosphodiester internucleoside linkages. In certain embodiments, the phosphodiester ("o") and phosphorothioate ("s") internucleoside linkages are arranged in the order from 5' to 3': sooooossssssssssooss or soooooosssssssssssoss, wherein each "s" represents a phosphorothioate internucleoside linkage and each "o" represents a phosphodiester internucleoside linkage.

The nucleobase sequences of SEQ ID NOs: 385, 416, 545, 621, 682, 1968, 2055, 2101, and 2150 are complementary to a portion of nucleobases 19146-19173 of SEQ ID NO: 2.

The nucleobase sequences of Compound Nos.: 1362670, 1363235, 1363627, 1363734, 1363940, 1364008, 1364066, 1523601, 1523602, and 1523603 are complementary to a portion of nucleobases 19146-19173 of SEQ ID NO: 2.

In certain embodiments, modified oligonucleotides complementary to a portion of nucleobases 19148-19173 of SEQ ID NO: 2 achieve at least 54% reduction of PLP1 RNA in the standard in vitro assay. In certain embodiments, modified oligonucleotides complementary to a portion of nucleobases 19146-19173 of SEQ ID NO: 2 achieve an average of 77.3% reduction of PLP1 RNA in the standard in vitro assay.

22. Nucleobases 19228-19253 of SEQ ID NO: 2

In certain embodiments, nucleobases 19228-19253 of SEQ ID NO: 2 comprise a hotspot region. In certain embodiments, modified oligonucleotides are complementary to a portion of nucleobases 19228-19253 of SEQ ID NO: 2. In certain embodiments, modified oligonucleotides are 20 nucleobases in length. In certain embodiments, modified oligonucleotides are 18 nucleobases in length. In certain embodiments, modified oligonucleotides are 16, 17, 18, 19, 20, 21, or 22 nucleobases in length. In certain embodiments, modified oligonucleotides consist of 17-19 or 21-30 linked nucleosides. In certain embodiments, modified oligonucleotides are gapmers. In certain embodiments, the gapmers are MOE gapmers. In certain embodiments, the gapmers are 5-10-5 MOE gapmers. In certain embodiments, the gapmers are 6-10-4 MOE gapmers. In certain embodiments, the gapmers are 4-10-6 MOE gapmers. In certain embodiments, the gapmers are 4-8-6 MOE gapmers. In certain embodiments, the gapmers are 6-8-4 MOE gapmers. In certain embodiments, the gapmers are 5-8-5 MOE gapmers. In certain embodiments, the gapmers have the sugar motif in order from 5' to 3': eeeeeddddddddddeeeee or eeeeeeddddddddddeeee, wherein 'd' represents a 2'-β-D-deoxyribosyl sugar moiety, and 'e' represents a 2'-MOE sugar moiety. In certain embodiments, the gapmers comprise a 2'-substituted nucleoside in the gap. In certain embodiments, the 2'-substituted nucleoside comprises a 2'-OMe sugar moiety. In certain embodiments, the 2'-substituted nucleoside is at position 2 of the gap (5' to 3').

In certain embodiments, all of the internucleoside linkages of the modified oligonucleotides are phosphorothioate internucleoside linkages. In certain embodiments, the internucleoside linkages of the modified oligonucleotides are phosphorothioate internucleoside linkages and phosphodiester internucleoside linkages. In certain embodiments, the phosphodiester ("o") and phosphorothioate ("s") internucleoside linkages are arranged in the order from 5' to 3': sooosssssssssssooss or soooosssssssssssoss, wherein each "s" represents a phosphorothioate internucleoside linkage and each "o" represents a phosphodiester internucleoside linkage.

The nucleobase sequences of SEQ ID NOs: 363, 467, 541, 2008, and 2111 are complementary to a portion of nucleobases 19228-19253 of SEQ ID NO: 2.

The nucleobase sequences of Compound Nos.: 1364015, 1363882, 1363157, 1363485, and 1362808 are complementary to a portion of nucleobases 19228-19253 of SEQ ID NO: 2.

In certain embodiments, modified oligonucleotides complementary to a portion of nucleobases 19228-19253 of SEQ ID NO: 2 achieve at least 69% reduction of PLP1 RNA in the standard in vitro assay. In certain embodiments, modified oligonucleotides complementary to a portion of nucleobases 19228-19253 of SEQ ID NO: 2 achieve an average of 77.4% reduction of PLP1 RNA in the standard in vitro assay.

23. Nucleobases 19347-19393 of SEQ ID NO: 2

In certain embodiments, nucleobases 19347-19393 of SEQ ID NO: 2 comprise a hotspot region. In certain embodiments, modified oligonucleotides are complementary to a portion of nucleobases 19347-19393 of SEQ ID NO: 2. In certain embodiments, modified oligonucleotides are 20 nucleobases in length. In certain embodiments, modified oligonucleotides are 18 nucleobases in length. In certain embodiments, modified oligonucleotides are 16, 17, 18, 19, 20, 21, or 22 nucleobases in length. In certain embodiments, modified oligonucleotides consist of 17-19 or 21-30 linked nucleosides. In certain embodiments, modified oligonucleotides are gapmers. In certain embodiments, the gapmers are MOE gapmers. In certain embodiments, the gapmers are 5-10-5 MOE gapmers. In certain embodiments, the gapmers are 6-10-4 MOE gapmers. In certain embodiments, the gapmers are 4-10-6 MOE gapmers. In certain embodiments, the gapmers are 4-8-6 MOE gapmers. In certain embodiments, the gapmers are 6-8-4 MOE gapmers. In certain embodiments, the gapmers are 5-8-5 MOE gapmers. In certain embodiments, the gapmers have the sugar motif in order from 5' to 3': eeeeeddddddddddeeeee or eeeeeeddddddddddeeee, wherein 'd' represents a 2'-β-D-deoxyribosyl sugar moiety, and 'e' represents a 2'-MOE sugar moiety. In certain embodiments, the gapmers comprise a 2'-substituted nucleoside in the gap. In certain embodiments, the 2'-substituted nucleoside comprises a 2'-OMe sugar moiety. In certain embodiments, the 2'-substituted nucleoside is at position 2 of the gap (5' to 3').

In certain embodiments, all of the internucleoside linkages of the modified oligonucleotides are phosphorothioate internucleoside linkages. In certain embodiments, the internucleoside linkages of the modified oligonucleotides are phosphorothioate internucleoside linkages and phosphodiester internucleoside linkages. In certain embodiments, the phosphodiester ("o") and phosphorothioate ("s") internucleoside linkages are arranged in the order from 5' to 3': sooosssssssssssooss or soooosssssssssssoss, wherein each "s" represents a phosphorothioate internucleoside linkage and each "o" represents a phosphodiester internucleoside linkage.

The nucleobase sequences of SEQ ID NOs: 58, 59, 136, 213, 214, 291, 292, 383, 417, 519, 612, 671, 730, 900, 986, 1019, 1136, 1353, 1457, 1504, 1546, and 2093 are complementary to a portion of nucleobases 19347-19393 of SEQ ID NO: 2.

The nucleobase sequences of Compound Nos.: 1218227, 1218228, 1218229, 1218230, 1218231, 1218232, 1218233, 1362526, 1362624, 1362677, 1362685, 1362799, 1362806, 1363094, 1363419, 1363425, 1363472, 1363499, 1363597, 1363628, 1363681, 1363744, 1363759, 1363800, and 1364257 are complementary to a portion of nucleobases 19347-19393 of SEQ ID NO: 2.

In certain embodiments, modified oligonucleotides complementary to a portion of nucleobases 19347-19393 of SEQ ID NO: 2 achieve at least 52% reduction of PLP1 RNA in the standard in vitro assay. In certain embodiments, modified oligonucleotides complementary to a portion of nucleobases 19347-19393 of SEQ ID NO: 2 achieve an average of 71.6% reduction of PLP1 RNA in the standard in vitro assay.

24. Nucleobases 19500-19523 of SEQ ID NO: 2

In certain embodiments, nucleobases 19500-19523 of SEQ ID NO: 2 comprise a hotspot region. In certain embodiments, modified oligonucleotides are complementary to a portion of nucleobases 19500-19523 of SEQ ID NO: 2. In certain embodiments, modified oligonucleotides are 20 nucleobases in length. In certain embodiments, modified oligonucleotides are 18 nucleobases in length. In certain embodiments, modified oligonucleotides are 16, 17, 18, 19, 20, 21, or 22 nucleobases in length. In certain embodiments, modified oligonucleotides consist of 17-19 or 21-30 linked nucleosides. In certain embodiments, modified oligonucleotides are gapmers. In certain embodiments, the gapmers are MOE gapmers. In certain embodiments, the gapmers are 5-10-5 MOE gapmers. In certain embodiments, the gapmers are 6-10-4 MOE gapmers. In certain embodiments, the gapmers are 4-10-6 MOE gapmers. In certain embodiments, the gapmers are 4-8-6 MOE gapmers. In certain embodiments, the gapmers are 6-8-4 MOE gapmers. In certain embodiments, the gapmers are 5-8-5 MOE gapmers. In certain embodiments, the gapmers have the sugar motif in order from 5' to 3': eeeeeddddddddddeeeee or eeeeeeddddddddddeeee, wherein 'd' represents a 2'-β-D-deoxyribosyl sugar moiety, and 'e' represents a 2'-MOE sugar moiety. In certain embodiments, the gapmers comprise a 2'-substituted nucleoside in the gap. In certain embodiments, the 2'-substituted nucleoside comprises a 2'-OMe sugar moiety. In certain embodiments, the 2'-substituted nucleoside is at position 2 of the gap (5' to 3').

In certain embodiments, all of the internucleoside linkages of the modified oligonucleotides are phosphorothioate internucleoside linkages. In certain embodiments, the internucleoside linkages of the modified oligonucleotides are phosphorothioate internucleoside linkages and phosphodiester internucleoside linkages. In certain embodiments, the phosphodiester ("o") and phosphorothioate ("s") internucleoside linkages are arranged in the order from 5' to 3': sooooossssssssssooss or soooooossssssssssoss, wherein each "s" represents a phosphorothioate internucleoside linkage and each "o" represents a phosphodiester internucleoside linkage.

The nucleobase sequences of SEQ ID NOs: 398, 435, 2095, 2010, and 2144 are complementary to a portion of nucleobases 19500-19523 of SEQ ID NO: 2.

The nucleobase sequences of Compound Nos.: 1362842, 1363110, 1363153, 1363982, 1523594, and 1523595 are complementary to a portion of nucleobases 19500-19523 of SEQ ID NO: 2.

In certain embodiments, modified oligonucleotides complementary to a portion of nucleobases 19500-19523 of SEQ ID NO: 2 achieve at least 62% reduction of PLP1 RNA in the standard in vitro assay. In certain embodiments, modified oligonucleotides complementary to a portion of nucleobases 19500-19523 of SEQ ID NO: 2 achieve an average of 69.5% reduction of PLP1 RNA in the standard in vitro assay.

25. Nucleobases 19512-19534 of SEQ ID NO: 2

In certain embodiments, nucleobases 19512-19534 of SEQ ID NO: 2 comprise a hotspot region. In certain embodiments, modified oligonucleotides are complementary to a portion of nucleobases 19512-19534 of SEQ ID NO: 2. In certain embodiments, modified oligonucleotides are 20 nucleobases in length. In certain embodiments, modified oligonucleotides are 18 nucleobases in length. In certain embodiments, modified oligonucleotides are 16, 17, 18, 19, 20, 21, or 22 nucleobases in length. In certain embodiments, modified oligonucleotides consist of 17-19 or 21-30 linked nucleosides. In certain embodiments, modified oligonucleotides are gapmers. In certain embodiments, the gapmers are MOE gapmers. In certain embodiments, the gapmers are 5-10-5 MOE gapmers. In certain embodiments, the gapmers are 6-10-4 MOE gapmers. In certain embodiments, the gapmers are 4-10-6 MOE gapmers. In certain embodiments, the gapmers are 4-8-6 MOE gapmers. In certain embodiments, the gapmers are 6-8-4 MOE gapmers. In certain embodiments, the gapmers are 5-8-5 MOE gapmers. In certain embodiments, the gapmers have the sugar motif in order from 5' to 3': eeeeeddddddddddeeeee or eeeeeeddddddddddeeee, wherein 'd' represents a 2'-β-D-deoxyribosyl sugar moiety, and 'e' represents a 2'-MOE sugar moiety. In certain embodiments, the gapmers comprise a 2'-substituted nucleoside in the gap. In certain embodiments, the 2'-substituted nucleoside comprises a 2'-OMe sugar moiety. In certain embodiments, the 2'-substituted nucleoside is at position 2 of the gap (5' to 3').

In certain embodiments, all of the internucleoside linkages of the modified oligonucleotides are phosphorothioate internucleoside linkages. In certain embodiments, the internucleoside linkages of the modified oligonucleotides are phosphorothioate internucleoside linkages and phosphodiester internucleoside linkages. In certain embodiments, the phosphodiester ("o") and phosphorothioate ("s") internucleoside linkages are arranged in the order from 5' to 3': sooooossssssssssooss or soooooossssssssssoss, wherein each "s" represents a phosphorothioate internucleoside linkage and each "o" represents a phosphodiester internucleoside linkage.

The nucleobase sequences of SEQ ID NOs: 1201, 1238, 1341, and 1435 are complementary to a portion of nucleobases 19512-19534 of SEQ ID NO: 2.

The nucleobase sequences of Compound Nos.: 1362602, 1363268, 1363452, and 1363678 are complementary to a portion of nucleobases 19512-19534 of SEQ ID NO: 2.

In certain embodiments, modified oligonucleotides complementary to a portion of nucleobases 19512-19534 of SEQ ID NO: 2 achieve at least 63% reduction of PLP1 RNA in the standard in vitro assay. In certain embodiments, modified oligonucleotides complementary to a portion of nucleobases 19512-19534 of SEQ ID NO: 2 achieve an average of 80% reduction of PLP1 RNA in the standard in vitro assay.

NONLIMITING DISCLOSURE AND INCORPORATION BY REFERENCE

Each of the literature and patent publications listed herein is incorporated by reference in its entirety.

While certain compounds, compositions and methods described herein have been described with specificity in accordance with certain embodiments, the following examples serve only to illustrate the compounds described herein and are not intended to limit the same. Each of the references, GenBank accession numbers, and the like recited in the present application is incorporated herein by reference in its entirety.

Although the sequence listing accompanying this filing identifies each sequence as either "RNA" or "DNA" as required, in reality, those sequences may be modified with any combination of chemical modifications. One of skill in the art will readily appreciate that such designation as "RNA" or "DNA" to describe modified oligonucleotides is, in certain instances, arbitrary. For example, an oligonucleotide comprising a nucleoside comprising a 2'-OH sugar moiety and a thymine base could be described as a DNA having a modified sugar moiety (2'-OH in place of one 2'-H of DNA) or as an RNA having a modified base (thymine (methylated uracil) in place of a uracil of RNA). Accordingly, nucleic acid sequences provided herein, including, but not limited to those in the sequence listing, are intended to encompass nucleic acids containing any combination of natural or modified RNA and/or DNA, including, but not limited to such nucleic acids having modified nucleobases. By way of further example and without limitation, an oligomeric compound having the nucleobase sequence "ATCGATCG" encompasses any oligomeric compounds having such nucleobase sequence, whether modified or unmodified, including, but not limited to, such compounds comprising RNA bases, such as those having sequence "AUCGAUCG" and those having some DNA bases and some RNA bases such as "AUCGATCG" and oligomeric compounds having other modified nucleobases, such as "AT$^{m}$CGAUCG," wherein $^{m}$C indicates a cytosine base comprising a methyl group at the 5-position.

Certain compounds described herein (e.g., modified oligonucleotides) have one or more asymmetric center and thus give rise to enantiomers, diastereomers, and other stereoisomeric configurations that may be defined, in terms of absolute stereochemistry, as (R) or (S), as α or β such as for sugar anomers, or as (D) or (L), such as for amino acids, etc. Compounds provided herein that are drawn or described as having certain stereoisomeric configurations include only the indicated compounds. Compounds provided herein that are drawn or described with undefined stereochemistry include all such possible isomers, including their stereorandom and optically pure forms, unless specified otherwise. Likewise, all cis- and trans-isomers and tautomeric forms of the compounds herein are also included unless otherwise indicated. Oligomeric compounds described herein include chirally pure or enriched mixtures as well as racemic mixtures. For example, oligomeric compounds having a plurality of phosphorothioate internucleoside linkages include such compounds in which chirality of the phosphorothioate internucleoside linkages is controlled or is random. Unless otherwise indicated, compounds described herein are intended to include corresponding salt forms.

The compounds described herein include variations in which one or more atoms are replaced with a non-radioactive isotope or radioactive isotope of the indicated element. For example, compounds herein that comprise hydrogen atoms encompass all possible deuterium substitutions for each of the $^{1}$H hydrogen atoms. Isotopic substitutions encompassed by the compounds herein include but are not limited to: $^{2}$H or $^{3}$H in place of $^{1}$H, $^{13}$C or $^{14}$C in place of $^{12}$C, $^{15}$N in place of $^{14}$N, $^{17}$O or $^{18}$O in place of $^{16}$O, and $^{33}$S, $^{34}$S, $^{35}$S, or $^{36}$S in place of $^{32}$S. In certain embodiments, non-radioactive isotopic substitutions may impart new properties on the oligomeric compound that are beneficial for use as a therapeutic or research tool. In certain embodiments, radioactive isotopic substitutions may make the compound suitable for research or diagnostic purposes such as imaging.

EXAMPLES

The following examples illustrate certain embodiments of the present disclosure and are not limiting. Moreover, where specific embodiments are provided, the inventors have contemplated generic application of those specific embodiments. For example, disclosure of an oligonucleotide having a particular motif provides reasonable support for additional oligonucleotides having the same or similar motif. And, for example, where a particular high-affinity modification appears at a particular position, other high-affinity modifications at the same position are considered suitable, unless otherwise indicated.

Example 1: Effect of 5-10-5 MOE Gapmer Modified Oligonucleotides on Human PLP1 RNA In Vitro, Single Dose Modified oligonucleotides complementary to human PLP1 nucleic acid were designed and tested for their single dose effects on PLP1 RNA in vitro. The modified oligonucleotides were tested in a series of experiments that had the same culture conditions, and the results for each experiment are presented in separate tables below.

The modified oligonucleotides in the tables below are 5-10-5 MOE gapmers. The gapmers are 20 nucleosides in length, wherein the central gap segment consists of ten 2'-β-D-deoxynucleosides and the 5' and 3' wing segments each consists of five 2'-MOE modified nucleosides. The sugar motif for the gapmers is (from 5' to 3'): eeeeeddddddddddeeeee; wherein 'd' represents a 2'-β-D-deoxyribosyl sugar moiety, and 'e' represents a 2'-MOE sugar moiety. The internucleoside linkages throughout each modified oligonucleotide are phosphorothioate internucleoside linkages. Each cytosine residue is a 5-methyl cytosine.

"Start site" indicates the 5'-most nucleoside to which the modified oligonucleotide is complementary in the target nucleic acid sequence. "Stop site" indicates the 3'-most nucleoside to which the modified oligonucleotide is complementary in the target nucleic acid sequence. Each modified oligonucleotide listed in the Tables below is 100% complementary to either human PLP1 mRNA, designated herein as SEQ ID NO: 1 (GENBANK Accession No. NM_001128834.2) or to the human PLP1 genomic sequence, designated herein as SEQ ID NO: 2 (GENBANK Accession No. NC_000023.11 truncated from nucleotides 103773001 to 103795000), or to both. 'N/A' indicates that the modified oligonucleotide is not 100% complementary to that particular target nucleic acid sequence.

Cultured SK-MEL-28 cells were treated with modified oligonucleotide at a concentration of 7,000 nM using electroporation at a density of 20,000 cells per well. After a treatment period of approximately 24 hours, total RNA was isolated from the cells and PLP1 RNA levels were measured by quantitative real-time RTPCR. PLP1 RNA levels were measured by Human PLP1 primer probe set RTS35092 (forward sequence CTGATGCCAGAATGTATGGTGT, designated herein as SEQ ID NO: 11; reverse sequence AGGTGGAAGGTCATTTGGAAC, designated herein as SEQ ID NO: 12; probe sequence TGCAGATGGACAGAAGGTTGGAGC, designated herein as SEQ ID NO: 13). PLP1 RNA levels were normalized to total RNA content, as measured by RIBOGREEN®. Reduction of PLP1 RNA is presented in the tables below as percent PLP1 RNA relative to the amount in untreated control cells (% UTC). Each table represents results from an individual assay plate. The values marked with an "T" indicate that the modified oligonucleotide is complementary to the amplicon region of the primer probe set. Additional assays may be used to measure the potency and efficacy of the modified oligonucleotides complementary to the amplicon region.

TABLE 1

Reduction of PLP1 RNA by 5-10-5 MOE gapmers with phosphorothioate internucleoside linkages in SK-MEL-28 cells

| Compound ID | SEQ ID NO: 1 Start Site | SEQ ID NO: 1 Stop Site | SEQ ID NO: 2 Start Site | SEQ ID NO: 2 Stop Site | Sequence (5' to 3') | PLP1 (% UTC) | SEQ ID No. |
|---|---|---|---|---|---|---|---|
| 1218077 | N/A | N/A | 3805 | 3824 | AGCCAACCCCCTTAAAGGGA | 96 | 20 |
| 1218081 | N/A | N/A | 3815 | 3834 | TCTGATTGACAGCCAACCCC | 92 | 21 |
| 1218085 | 238 | 257 | 3948 | 3967 | CCGGCTGGCTAGTCTGCTTT | 43 | 22 |
| 1218089 | 249 | 268 | 3959 | 3978 | TCCAATTGTAGCCGGCTGGC | 62 | 23 |
| 1218093 | 305 | 324 | 12597 | 12616 | CCCTACCAGACATCTTGCAC | 39 | 24 |
| 1218097 | 551 | 570 | 13539 | 13558 | GCCGGTGGTGTAGAAGCCCT | 67 | 25 |
| 1218101 | 564 | 583 | 13552 | 13571 | TCTGCCTGACTGCGCCGGTG | 31 | 26 |
| 1218105 | 577 | 596 | 13565 | 13584 | TAGTCGCCAAAGATCTGCCT | 50 | 27 |

TABLE 1-continued

Reduction of PLP1 RNA by 5-10-5 MOE gapmers with phosphorothioate internucleoside linkages in SK-MEL-28 cells

| Compound ID | SEQ ID NO: 1 Start Site | SEQ ID NO: 1 Stop Site | SEQ ID NO: 2 Start Site | SEQ ID NO: 2 Stop Site | Sequence (5' to 3') | PLP1 (% UTC) | SEQ ID No. |
|---|---|---|---|---|---|---|---|
| 1218109 | 589 | 608 | 13577 | 13596 | ATGGTGGTCTTGTAGTCGCC | 47 | 28 |
| 1218113 | 600 | 619 | 13588 | 13607 | CCTTGCCGCAGATGGTGGTC | 54 | 29 |
| 1218117 | 604 | 623 | 13592 | 13611 | AGGCCCTTGCCGCAGATGGT | 51 | 30 |
| 1218121 | 614 | 633 | 13602 | 13621 | CGTTGCGCTCAGGCCCTTGC | 70 | 31 |
| 1218125 | 620 | 639 | 13608 | 13627 | TGTTACCGTTGCGCTCAGGC | 64 | 32 |
| 1218129 | 624 | 643 | 13612 | 13631 | CCCCTGTTACCGTTGCGCTC | 76 | 33 |
| 1218133 | 656 | 675 | 13644 | 13663 | ATGTTGGCCTCTGGAACCCC | 51 | 34 |
| 1218137 | 689 | 708 | 13677 | 13696 | ACAATGACACACCCGCTCCA | 75 | 35 |

TABLE 1-continued

Reduction of PLP1 RNA by 5-10-5 MOE gapmers with phosphorothioate internucleoside linkages in SK-MEL-28 cells

| Compound ID | SEQ ID NO: 1 Start Site | SEQ ID NO: 1 Stop Site | SEQ ID NO: 2 Start Site | SEQ ID NO: 2 Stop Site | Sequence (5' to 3') | PLP1 (% UTC) | SEQ ID No. |
|---|---|---|---|---|---|---|---|
| 1218141 | 717 | 736 | 13705 | 13724 | TGTCGGGATGTCCTAGCCAT | 31 | 36 |
| 1218145 | 757 | 776 | 14816 | 14835 | AGCCACACAACGGTCAGGGC | 25 | 37 |
| 1218149 | 815 | 834 | 14874 | 14893 | GGTGGTCCAGGTGTTGAAGT | 75 | 38 |
| 1218153 | 907 | 926 | 15436 | 15455 | GCATTCCATGGGAGAACACC | 29† | 39 |
| 1218157 | 1099 | 1118 | 17578 | 17597 | CAGAACTTGGTGCCTCGGCC | 16 | 40 |
| 1218161 | 1104 | 1123 | 17583 | 17602 | GGGATCAGAACTTGGTGCCT | 38 | 41 |
| 1218165 | 1151 | 1170 | 17630 | 17649 | GCTGTGTGGTTAGAGCCTCG | 19 | 42 |
| 1218169 | 1169 | 1188 | 17648 | 17667 | GGAGACGCAGCATTGTAGGC | 36 | 43 |
| 1218173 | 1528 | 1547 | 18007 | 18026 | GGCCCCTATAGATGGCAAGA | 46 | 44 |
| 1218177 | 1727 | 1746 | 18206 | 18225 | CAGTAGTCCATCGCCATCGG | 28 | 45 |
| 1218181 | 1734 | 1753 | 18213 | 18232 | AGGGCTTCAGTAGTCCATCG | 12 | 46 |
| 1218185 | 1747 | 1766 | 18226 | 18245 | GGTTGGCTGAGTTAGGGCTT | 25 | 47 |
| 1218189 | 1764 | 1783 | 18243 | 18262 | CCTTATGCTGTAAGTAAGGT | 24 | 48 |
| 1218193 | 1770 | 1789 | 18249 | 18268 | ACGCTCCCTTATGCTGTAAG | 11 | 49 |
| 1218197 | 1774 | 1793 | 18253 | 18272 | TTCTACGCTCCCTTATGCTG | 40 | 50 |
| 1218201 | 1782 | 1801 | 18261 | 18280 | TACACAGATTCTACGCTCCC | 29 | 51 |

TABLE 1-continued

Reduction of PLP1 RNA by 5-10-5 MOE gapmers with phosphorothioate internucleoside linkages in SK-MEL-28 cells

| Compound ID | SEQ ID NO: 1 Start Site | SEQ ID NO: 1 Stop Site | SEQ ID NO: 2 Start Site | SEQ ID NO: 2 Stop Site | Sequence (5' to 3') | PLP1 (% UTC) | SEQ ID No. |
|---|---|---|---|---|---|---|---|
| 1218205 | 1807 | 1826 | 18286 | 18305 | TGTAAGGCCAGATGCCCCCT | 34 | 52 |
| 1218209 | 1824 | 1843 | 18303 | 18322 | TCTCTTCCCTAACGAGGTGT | 9 | 53 |
| 1218213 | 1983 | 2002 | 18462 | 18481 | AGGTTACACCATTAGCCACC | 25 | 54 |
| 1218217 | 2005 | 2024 | 18484 | 18503 | GTGTCTACCAGAGGGCCATC | 27 | 55 |
| 1218221 | 2318 | 2337 | 18797 | 18816 | CCAATAGATTCAACTAGCCA | 22 | 56 |
| 1218225 | 2582 | 2601 | 19061 | 19080 | GGAGCTATTCAGGTCTCAAA | 12 | 57 |
| 1218229 | 2880 | 2899 | 19359 | 19378 | TACGGATTACTTCACTGTCC | 18 | 58 |
| 1218233 | 2888 | 2907 | 19367 | 19386 | ACACAAGGTACGGATTACTT | 23 | 59 |
| 1218237 | 36 | 55 | 3541 | 3560 | TCCTTGGGTCTAATTGGTGT | 93 | 60 |
| 1218241 | 115 | 134 | 3620 | 3639 | TCGCTTTGCTGCAGAGACAT | 88 | 61 |
| 1218245 | N/A | N/A | 1120 | 1139 | TGGGCCCCCTTGATCATGGC | 90 | 62 |
| 1218249 | N/A | N/A | 1412 | 1431 | GCTCCCTACAGACCTCATAG | 93 | 63 |
| 1218253 | N/A | N/A | 2172 | 2191 | GGTCCTAGAGCCCCTCGCCC | 94 | 64 |
| 1218257 | N/A | N/A | 2814 | 2833 | CCTGCCTTAGCAATAAGCTA | 91 | 65 |
| 1218261 | N/A | N/A | 3457 | 3476 | AACCTAGATATTAGCTCCCA | 91 | 66 |
| 1218265 | N/A | N/A | 4445 | 4464 | GCCCGATCCCCAGCTTCCTA | 78 | 67 |

TABLE 1-continued

Reduction of PLP1 RNA by 5-10-5 MOE gapmers with phosphorothioate internucleoside linkages in SK-MEL-28 cells

| Compound ID | SEQ ID NO: 1 Start Site | SEQ ID NO: 1 Stop Site | SEQ ID NO: 2 Start Site | SEQ ID NO: 2 Stop Site | Sequence (5' to 3') | PLP1 (% UTC) | SEQ ID No. |
|---|---|---|---|---|---|---|---|
| 1218269 | N/A | N/A | 5257 | 5276 | GTTGTTATAGATCTTGCCCA | 38 | 68 |
| 1218273 | N/A | N/A | 5479 | 5498 | TGCACAACCTATCCAGTCAG | 65 | 69 |
| 1218277 | N/A | N/A | 5871 | 5890 | CCAATCCCGGATTCCATGAT | 55 | 70 |
| 1218281 | N/A | N/A | 5994 | 6013 | GTTGAAGTAGTAAGTTCCCT | 34 | 71 |
| 1218285 | N/A | N/A | 6371 | 6390 | GCCGCCACACTTTTTGCCTG | 45 | 72 |
| 1218289 | N/A | N/A | 7095 | 7114 | AGGGCCATTTTGCCGTAGGC | 46 | 73 |
| 1218293 | N/A | N/A | 7523 | 7542 | CGATTTAGTATTACCACGGC | 24 | 74 |
| 1218297 | N/A | N/A | 7663 | 7682 | GATATCAGCACTTATATACC | 86 | 75 |
| 1218301 | N/A | N/A | 8082 | 8101 | ACCAATTGTACCCTGCACAA | 65 | 76 |
| 1218305 | N/A | N/A | 8355 | 8374 | TTAAGCCCTTCTCACCAGCG | 49 | 77 |
| 1218309 | N/A | N/A | 9005 | 9024 | CCATTGGGCTCCCTTTGATT | 49 | 78 |
| 1218313 | N/A | N/A | 9645 | 9664 | GTGCTTGTGCAGGTATGGTC | 26 | 79 |
| 1218317 | N/A | N/A | 9713 | 9732 | TCCACCCTAGCAAGTGACCA | 68 | 80 |
| 1218321 | N/A | N/A | 10517 | 10536 | GAGTCCTATTACCCACCATC | 47 | 81 |
| 1218325 | N/A | N/A | 10523 | 10542 | AGGAGTGAGTCCTATTACCC | 56 | 82 |
| 1218329 | N/A | N/A | 11359 | 11378 | CCCTCAGTTATACGCTGAGA | 43 | 83 |

TABLE 1-continued

Reduction of PLP1 RNA by 5-10-5 MOE gapmers with phosphorothioate internucleoside linkages in SK-MEL-28 cells

| Compound ID | SEQ ID NO: 1 Start Site | SEQ ID NO: 1 Stop Site | SEQ ID NO: 2 Start Site | SEQ ID NO: 2 Stop Site | Sequence (5' to 3') | PLP1 (% UTC) | SEQ ID No. |
|---|---|---|---|---|---|---|---|
| 1218333 | N/A | N/A | 11465 | 11484 | AGGAGGTTTGATATTACTCC | 64 | 84 |
| 1218337 | N/A | N/A | 13224 | 13243 | ACCTTGCTTACCCTGGGACC | 50 | 85 |
| 1218341 | N/A | N/A | 13709 | 13728 | ACCTTGTCGGGATGTCCTAG | 39 | 86 |
| 1218345 | N/A | N/A | 13766 | 13785 | ACTCGCGCCCAATTTTCCCC | 50 | 87 |
| 1218349 | N/A | N/A | 13777 | 13796 | CGAGGCCACAGACTCGCGCC | 49 | 88 |
| 1218353 | N/A | N/A | 14039 | 14058 | CCAGTTAGATCCACTCTTGT | 29 | 89 |
| 1218357 | N/A | N/A | 14083 | 14102 | GGTGCCCAAGTCTCAATCAC | 43 | 90 |
| 1218361 | N/A | N/A | 14608 | 14627 | TCTACTAGATAACTGGCCCC | 64 | 91 |
| 1218365 | N/A | N/A | 14964 | 14983 | CCCGTACCCTAACTCACCAT | 77† | 92 |
| 1218369 | N/A | N/A | 15536 | 15555 | GGTATTAGCTACTCCCTTGT | 40 | 93 |
| 1218373 | N/A | N/A | 15765 | 15784 | CCATTAGGCTCTATCTTTAC | 52 | 94 |
| 1218377 | N/A | N/A | 16150 | 16169 | TCAGTGTACACCATAGCACC | 37 | 95 |
| 1218381 | N/A | N/A | 16531 | 16550 | AAGTACGGAGCCTCCACCCT | 74 | 96 |
| 1218385 | N/A | N/A | 17129 | 17148 | CAGTAGAGCTCTCCCCTGGT | 66 | 97 |

TABLE 2

Reduction of PLP1 RNA by 5-10-5 MOE gapmers with phosphorothioate internucleoside linkages in SK-MEL-28 cells

| Compound ID | SEQ ID NO: 1 Start Site | SEQ ID NO: 1 Stop Site | SEQ ID NO: 2 Start Site | SEQ ID NO: 2 Stop Site | Sequence (5' to 3') | PLP1 (% UTC) | SEQ ID No. |
|---|---|---|---|---|---|---|---|
| 1218078 | N/A | N/A | 3806 | 3825 | CAGCCAACCCCCTTAAAGGG | 102 | 98 |
| 1218082 | N/A | N/A | 3816 | 3835 | TTCTGATTGACAGCCAACCC | 111 | 99 |
| 1218086 | 241 | 260 | 3951 | 3970 | TAGCCGGCTGGCTAGTCTGC | 45 | 100 |
| 1218090 | 251 | 270 | 3961 | 3980 | ACTCCAATTGTAGCCGGCTG | 67 | 101 |
| 1218094 | 307 | 326 | 12599 | 12618 | GCCCCTACCAGACATCTTGC | 34 | 102 |
| 1218098 | 557 | 576 | 13545 | 13564 | GACTGCGCCGGTGGTGTAGA | 66 | 103 |
| 1218102 | 566 | 585 | 13554 | 13573 | GATCTGCCTGACTGCGCCGG | 53 | 104 |
| 1218106 | 578 | 597 | 13566 | 13585 | GTAGTCGCCAAAGATCTGCC | 58 | 105 |
| 1218110 | 590 | 609 | 13578 | 13597 | GATGGTGGTCTTGTAGTCGC | 77 | 106 |
| 1218114 | 601 | 620 | 13589 | 13608 | CCCTTGCCGCAGATGGTGGT | 48 | 107 |
| 1218118 | 609 | 628 | 13597 | 13616 | CGCTCAGGCCCTTGCCGCAG | 21 | 108 |
| 1218122 | 617 | 636 | 13605 | 13624 | TACCGTTGCGCTCAGGCCCT | 71 | 109 |
| 1218126 | 621 | 640 | 13609 | 13628 | CTGTTACCGTTGCGCTCAGG | 90 | 110 |
| 1218130 | 625 | 644 | 13613 | 13632 | CCCCCTGTTACCGTTGCGCT | 76 | 111 |
| 1218134 | 657 | 676 | 13645 | 13664 | GATGTTGGCCTCTGGAACCC | 50 | 112 |
| 1218138 | 693 | 712 | 13681 | 13700 | CCAAACAATGACACACCCGC | 71 | 113 |

TABLE 2-continued

Reduction of PLP1 RNA by 5-10-5 MOE gapmers with phosphorothioate internucleoside linkages in SK-MEL-28 cells

| Compound ID | SEQ ID NO: 1 Start Site | SEQ ID NO: 1 Stop Site | SEQ ID NO: 2 Start Site | SEQ ID NO: 2 Stop Site | Sequence (5' to 3') | PLP1 (% UTC) | SEQ ID No. |
|---|---|---|---|---|---|---|---|
| 1218142 | 718 | 737 | 13706 | 13725 | TTGTCGGGATGTCCTAGCCA | 40 | 114 |
| 1218146 | 759 | 778 | 14818 | 14837 | GGAGCCACACAACGGTCAGG | 62 | 115 |
| 1218150 | 860 | 879 | 14919 | 14938 | GCCTATACTGGCAGAGGTCT | 38 | 116 |
| 1218154 | 1080 | 1099 | 17559 | 17578 | CCATGAGTTTAAGGACGGCA | 24 | 117 |
| 1218158 | 1100 | 1119 | 17579 | 17598 | TCAGAACTTGGTGCCTCGGC | 31 | 118 |
| 1218162 | 1144 | 1163 | 17623 | 17642 | GGTTAGAGCCTCGCTATTAG | 20 | 119 |
| 1218166 | 1164 | 1183 | 17643 | 17662 | CGCAGCATTGTAGGCTGTGT | 18 | 120 |
| 1218170 | 1180 | 1199 | 17659 | 17678 | GAGTTAAGATGGGAGACGCA | 46 | 121 |
| 1218174 | 1531 | 1550 | 18010 | 18029 | TTTGGCCCCTATAGATGGCA | 41 | 122 |
| 1218178 | 1728 | 1747 | 18207 | 18226 | TCAGTAGTCCATCGCCATCG | 21 | 123 |
| 1218182 | 1737 | 1756 | 18216 | 18235 | GTTAGGGCTTCAGTAGTCCA | 24 | 124 |
| 1218186 | 1758 | 1777 | 18237 | 18256 | GCTGTAAGTAAGGTTGGCTG | 17 | 125 |
| 1218190 | 1765 | 1784 | 18244 | 18263 | CCCTTATGCTGTAAGTAAGG | 20 | 126 |
| 1218194 | 1771 | 1790 | 18250 | 18269 | TACGCTCCCTTATGCTGTAA | 22 | 127 |
| 1218198 | 1778 | 1797 | 18257 | 18276 | CAGATTCTACGCTCCCTTAT | 52 | 128 |
| 1218202 | 1783 | 1802 | 18262 | 18281 | CTACACAGATTCTACGCTCC | 36 | 129 |

TABLE 2-continued

Reduction of PLP1 RNA by 5-10-5 MOE gapmers with phosphorothioate internucleoside linkages in SK-MEL-28 cells

| Compound ID | SEQ ID NO: 1 Start Site | SEQ ID NO: 1 Stop Site | SEQ ID NO: 2 Start Site | SEQ ID NO: 2 Stop Site | Sequence (5' to 3') | PLP1 (% UTC) | SEQ ID No. |
|---|---|---|---|---|---|---|---|
| 1218206 | 1808 | 1827 | 18287 | 18306 | GTGTAAGGCCAGATGCCCCC | 38 | 130 |
| 1218210 | 1825 | 1844 | 18304 | 18323 | TTCTCTTCCCTAACGAGGTG | 25 | 131 |
| 1218214 | 1985 | 2004 | 18464 | 18483 | TCAGGTTACACCATTAGCCA | 23 | 132 |
| 1218218 | 2006 | 2025 | 18485 | 18504 | TGTGTCTACCAGAGGGCCAT | 26 | 133 |
| 1218222 | 2319 | 2338 | 18798 | 18817 | CCCAATAGATTCAACTAGCC | 16 | 134 |
| 1218226 | 2583 | 2602 | 19062 | 19081 | GGGAGCTATTCAGGTCTCAA | 16 | 135 |
| 1218230 | 2881 | 2900 | 19360 | 19379 | GTACGGATTACTTCACTGTC | 31 | 136 |
| 1218234 | 17 | 36 | 3522 | 3541 | TGGGATATGCAGCACAAGCG | 61 | 137 |
| 1218238 | 37 | 56 | 3542 | 3561 | ATCCTTGGGTCTAATTGGTG | 104 | 138 |
| 1218242 | 121 | 140 | 3626 | 3645 | GGAATTTCGCTTTGCTGCAG | 98 | 139 |
| 1218246 | N/A | N/A | 1121 | 1140 | CTGGGCCCCCTTGATCATGG | 107 | 140 |
| 1218250 | N/A | N/A | 1468 | 1487 | GCTCTGTACATCCCGACACT | 91 | 141 |
| 1218254 | N/A | N/A | 2246 | 2265 | CTGCCCCTTGCAAAACGGTA | 90 | 142 |
| 1218258 | N/A | N/A | 3019 | 3038 | AGGTAGTCAGTATTCTATCC | 101 | 143 |
| 1218262 | N/A | N/A | 3630 | 3649 | GCCTGGAATTTCGCTTTGCT | 102 | 144 |
| 1218266 | N/A | N/A | 4450 | 4469 | AGCTTGCCCGATCCCCAGCT | 55 | 145 |

TABLE 2-continued

Reduction of PLP1 RNA by 5-10-5 MOE gapmers with phosphorothioate internucleoside linkages in SK-MEL-28 cells

| Compound ID | SEQ ID NO: 1 Start Site | SEQ ID NO: 1 Stop Site | SEQ ID NO: 2 Start Site | SEQ ID NO: 2 Stop Site | Sequence (5' to 3') | PLP1 (% UTC) | SEQ ID No. |
|---|---|---|---|---|---|---|---|
| 1218270 | N/A | N/A | 5258 | 5277 | AGTTGTTATAGATCTTGCCC | 41 | 146 |
| 1218274 | N/A | N/A | 5642 | 5661 | CGTGCCCTTATCTGTGGCAC | 93 | 147 |
| 1218278 | N/A | N/A | 5880 | 5899 | AAGTTCCTTCCAATCCCGGA | 44 | 148 |
| 1218282 | N/A | N/A | 6231 | 6250 | GCTTGCAGACAATGTTTTGC | 54 | 149 |
| 1218286 | N/A | N/A | 6416 | 6435 | ACTCAGTTAGTCTTCGGGCA | 32 | 150 |
| 1218290 | N/A | N/A | 7164 | 7183 | GGGACTCTTTTCTAGAGCCC | 55 | 151 |
| 1218294 | N/A | N/A | 7527 | 7546 | GACACGATTTAGTATTACCA | 50 | 152 |
| 1218298 | N/A | N/A | 7859 | 7878 | GCAGTAGTTGACAAGGCCGA | 63 | 153 |
| 1218302 | N/A | N/A | 8084 | 8103 | AGACCAATTGTACCCTGCAC | 58 | 154 |
| 1218306 | N/A | N/A | 8367 | 8386 | GATACTCCAACTTTAAGCCC | 67 | 155 |
| 1218310 | N/A | N/A | 9421 | 9440 | GAGTCACCAGATCATAGCCT | 46 | 156 |
| 1218314 | N/A | N/A | 9691 | 9710 | TTGGGCCTACTCACTCATCC | 75 | 157 |
| 1218318 | N/A | N/A | 9750 | 9769 | GCAGGACTGTTTGTTTAGCC | 51 | 158 |
| 1218322 | N/A | N/A | 10518 | 10537 | TGAGTCCTATTACCCACCAT | 68 | 159 |
| 1218326 | N/A | N/A | 11020 | 11039 | CCTCTCGGCCAGATCCCTAA | 92 | 160 |
| 1218330 | N/A | N/A | 11378 | 11397 | AGCTTGGCTAATGTCCCCAC | 59 | 161 |

TABLE 2-continued

Reduction of PLP1 RNA by 5-10-5 MOE gapmers with phosphorothioate internucleoside linkages in SK-MEL-28 cells

| Compound ID | SEQ ID NO: 1 Start Site | SEQ ID NO: 1 Stop Site | SEQ ID NO: 2 Start Site | SEQ ID NO: 2 Stop Site | Sequence (5' to 3') | PLP1 (% UTC) | SEQ ID No. |
|---|---|---|---|---|---|---|---|
| 1218334 | N/A | N/A | 12872 | 12891 | CGGGAATCCGGTCTGGCTCC | 72 | 162 |
| 1218338 | N/A | N/A | 13226 | 13245 | ACACCTTGCTTACCCTGGGA | 47 | 163 |
| 1218342 | N/A | N/A | 13719 | 13738 | GAGGATGATCACCTTGTCGG | 35 | 164 |
| 1218346 | N/A | N/A | 13767 | 13786 | GACTCGCGCCCAATTTTCCC | 64 | 165 |
| 1218350 | N/A | N/A | 13780 | 13799 | GGACGAGGCCACAGACTCGC | 69 | 166 |
| 1218354 | N/A | N/A | 14041 | 14060 | GTCCAGTTAGATCCACTCTT | 16 | 167 |
| 1218358 | N/A | N/A | 14181 | 14200 | CCTCTGGGACCTCGAACTGT | 88 | 168 |
| 1218362 | N/A | N/A | 14793 | 14812 | GGTGATGCCCACAAACTAAA | 91 | 169 |
| 1218366 | N/A | N/A | 14965 | 14984 | ACCCGTACCCTAACTCACCA | 91† | 170 |
| 1218370 | N/A | N/A | 15540 | 15559 | GTATGGTATTAGCTACTCCC | 24 | 171 |
| 1218374 | N/A | N/A | 15985 | 16004 | CCCCGGATTTACTTTTATTC | 55 | 172 |
| 1218378 | N/A | N/A | 16154 | 16173 | GTCTTCAGTGTACACCATAG | 37 | 173 |
| 1218382 | N/A | N/A | 16689 | 16708 | ACCGTAATTTATGACTGCAA | 24 | 174 |
| 1218386 | N/A | N/A | 17183 | 17202 | TCCGAGTGACTTAGAGTCAT | 32 | 175 |

TABLE 3

Reduction of PLP1 RNA by 5-10-5 MOE gapmers with phosphorothioate internucleoside linkages in SK-MEL-28 cells

| Compound ID | SEQ ID NO: 1 Start Site | SEQ ID NO: 1 Stop Site | SEQ ID NO: 2 Start Site | SEQ ID NO: 2 Stop Site | Sequence (5' to 3') | PLP1 (% UTC) | SEQ ID No. |
|---|---|---|---|---|---|---|---|
| 1218079 | N/A | N/A | 3813 | 3832 | TGATTGACAGCCAACCCCCT | 104 | 176 |
| 1218083 | 235 | 254 | 3945 | 3964 | GCTGGCTAGTCTGCTTTGTG | 34 | 177 |
| 1218087 | 244 | 263 | 3954 | 3973 | TTGTAGCCGGCTGGCTAGTC | 47 | 178 |
| 1218091 | 252 | 271 | 3962 | 3981 | GACTCCAATTGTAGCCGGCT | 62 | 179 |
| 1218095 | 309 | 328 | 12601 | 12620 | GGGCCCCTACCAGACATCTT | 75 | 180 |
| 1218099 | 561 | 580 | 13549 | 13568 | GCCTGACTGCGCCGGTGGTG | 34 | 181 |
| 1218103 | 575 | 594 | 13563 | 13582 | GTCGCCAAAGATCTGCCTGA | 56 | 182 |
| 1218107 | 584 | 603 | 13572 | 13591 | GGTCTTGTAGTCGCCAAAGA | 62 | 183 |
| 1218111 | 593 | 612 | 13581 | 13600 | GCAGATGGTGGTCTTGTAGT | 68 | 184 |
| 1218115 | 602 | 621 | 13590 | 13609 | GCCCTTGCCGCAGATGGTGG | 30 | 185 |
| 1218119 | 610 | 629 | 13598 | 13617 | GCGCTCAGGCCCTTGCCGCA | 40 | 186 |
| 1218123 | 618 | 637 | 13606 | 13625 | TTACCGTTGCGCTCAGGCCC | 53 | 187 |
| 1218127 | 622 | 641 | 13610 | 13629 | CCTGTTACCGTTGCGCTCAG | 76 | 188 |
| 1218131 | 629 | 648 | 13617 | 13636 | CTGGCCCCCTGTTACCGTTG | 53 | 189 |
| 1218135 | 677 | 696 | 13665 | 13684 | CCGCTCCAAAGAATGAGCTT | 32 | 190 |
| 1218139 | 714 | 733 | 13702 | 13721 | CGGGATGTCCTAGCCATTTT | 26 | 191 |

TABLE 3-continued

Reduction of PLP1 RNA by 5-10-5 MOE gapmers with phosphorothioate internucleoside linkages in SK-MEL-28 cells

| Compound ID | SEQ ID NO: 1 Start Site | SEQ ID NO: 1 Stop Site | SEQ ID NO: 2 Start Site | SEQ ID NO: 2 Stop Site | Sequence (5' to 3') | PLP1 (% UTC) | SEQ ID No. |
|---|---|---|---|---|---|---|---|
| 1218143 | 739 | 758 | 14798 | 14817 | GCATAGGTGATGCCCACAAA | 77 | 192 |
| 1218147 | 762 | 781 | 14821 | 14840 | CCAGGAGCCACACAACGGTC | 43 | 193 |
| 1218151 | 861 | 880 | 14920 | 14939 | TGCCTATACTGGCAGAGGTC | 41 | 194 |
| 1218155 | 1091 | 1110 | 17570 | 17589 | GGTGCCTCGGCCCATGAGTT | 18 | 195 |
| 1218159 | 1102 | 1121 | 17581 | 17600 | GATCAGAACTTGGTGCCTCG | 34 | 196 |
| 1218163 | 1148 | 1167 | 17627 | 17646 | GTGTGGTTAGAGCCTCGCTA | 14 | 197 |
| 1218167 | 1165 | 1184 | 17644 | 17663 | ACGCAGCATTGTAGGCTGTG | 17 | 198 |
| 1218171 | 1450 | 1469 | 17929 | 17948 | AGTGGAAGTACCCTTTGAGA | 39 | 199 |
| 1218175 | 1650 | 1669 | 18129 | 18148 | TGCAATAGGCAGATTTGGGC | 14 | 200 |
| 1218179 | 1731 | 1750 | 18210 | 18229 | GCTTCAGTAGTCCATCGCCA | 7 | 201 |
| 1218183 | 1738 | 1757 | 18217 | 18236 | AGTTAGGGCTTCAGTAGTCC | 19 | 202 |
| 1218187 | 1759 | 1778 | 18238 | 18257 | TGCTGTAAGTAAGGTTGGCT | 22 | 203 |
| 1218191 | 1768 | 1787 | 18247 | 18266 | GCTCCCTTATGCTGTAAGTA | 14 | 204 |
| 1218195 | 1772 | 1791 | 18251 | 18270 | CTACGCTCCCTTATGCTGTA | 23 | 205 |
| 1218199 | 1779 | 1798 | 18258 | 18277 | ACAGATTCTACGCTCCCTTA | 36 | 206 |
| 1218203 | 1784 | 1803 | 18263 | 18282 | TCTACACAGATTCTACGCTC | 17 | 207 |

TABLE 3-continued

Reduction of PLP1 RNA by 5-10-5 MOE gapmers with phosphorothioate internucleoside linkages in SK-MEL-28 cells

| Compound ID | SEQ ID NO: 1 Start Site | SEQ ID NO: 1 Stop Site | SEQ ID NO: 2 Start Site | SEQ ID NO: 2 Stop Site | Sequence (5' to 3') | PLP1 (% UTC) | SEQ ID No. |
|---|---|---|---|---|---|---|---|
| 1218207 | 1809 | 1828 | 18288 | 18307 | GGTGTAAGGCCAGATGCCCC | 22 | 208 |
| 1218211 | 1885 | 1904 | 18364 | 18383 | GGTTGTCATGGTAGCTGTTA | 22 | 209 |
| 1218215 | 1986 | 2005 | 18465 | 18484 | CTCAGGTTACACCATTAGCC | 16 | 210 |
| 1218219 | 2120 | 2139 | 18599 | 18618 | GACTGAATGGATAATACCCC | 9 | 211 |
| 1218223 | 2515 | 2534 | 18994 | 19013 | GATGACTGGTGCATTCTGTT | 17 | 212 |
| 1218227 | 2878 | 2897 | 19357 | 19376 | CGGATTACTTCACTGTCCTT | 27 | 213 |
| 1218231 | 2882 | 2901 | 19361 | 19380 | GGTACGGATTACTTCACTGT | 23 | 214 |
| 1218235 | 21 | 40 | 3526 | 3545 | GGTGTGGGATATGCAGCACA | 91 | 215 |
| 1218239 | 38 | 57 | 3543 | 3562 | GATCCTTGGGTCTAATTGGT | 53 | 216 |
| 1218243 | N/A | N/A | 900 | 919 | AAGTGCCCAATCTAGTGGCC | 58 | 217 |
| 1218247 | N/A | N/A | 1359 | 1378 | ATCTACATACCCCCACCTAT | 90 | 218 |
| 1218251 | N/A | N/A | 1537 | 1556 | GGTGACCGTGTCTCACTCAT | 98 | 219 |
| 1218255 | N/A | N/A | 2308 | 2327 | TACTAGAACTCTAGATCCTT | 101 | 220 |
| 1218259 | N/A | N/A | 3070 | 3089 | CCAAGAAGGATAATCGACTT | 72 | 221 |
| 1218263 | N/A | N/A | 4083 | 4102 | CGACTCATTTAAACCATGGA | 51 | 222 |
| 1218267 | N/A | N/A | 4974 | 4993 | CCAGCTCAGTATAATTGCAA | 23 | 223 |

TABLE 3-continued

Reduction of PLP1 RNA by 5-10-5 MOE gapmers with phosphorothioate internucleoside linkages in SK-MEL-28 cells

| Compound ID | SEQ ID NO: 1 Start Site | SEQ ID NO: 1 Stop Site | SEQ ID NO: 2 Start Site | SEQ ID NO: 2 Stop Site | Sequence (5' to 3') | PLP1 (% UTC) | SEQ ID No. |
|---|---|---|---|---|---|---|---|
| 1218271 | N/A | N/A | 5443 | 5462 | TAGGATTCCTGATGTTACCC | 47 | 224 |
| 1218275 | N/A | N/A | 5668 | 5687 | CCTGGGACCCAATGTGCATC | 27 | 225 |
| 1218279 | N/A | N/A | 5947 | 5966 | GTACGAACATTTAATTGGTT | 39 | 226 |
| 1218283 | N/A | N/A | 6249 | 6268 | GTTCTCAGACGACAACAGGC | 43 | 227 |
| 1218287 | N/A | N/A | 6716 | 6735 | TGTTATTACTCAGATCGCTC | 45 | 228 |
| 1218291 | N/A | N/A | 7261 | 7280 | GTAGCCATACCTTGTTCCTC | 33 | 229 |
| 1218295 | N/A | N/A | 7587 | 7606 | GCTGGATAGTCAAATCATGT | 45 | 230 |
| 1218299 | N/A | N/A | 7911 | 7930 | AACCCACCCCTTAACCTTAC | 91 | 231 |
| 1218303 | N/A | N/A | 8189 | 8208 | TGGGCCCGCCTCAAGGACCA | 71 | 232 |
| 1218307 | N/A | N/A | 8814 | 8833 | CCAGTCTAAGTACAGACTGC | 91 | 233 |
| 1218311 | N/A | N/A | 9519 | 9538 | AGTGTATCTGATCCCTCAAT | 65 | 234 |
| 1218315 | N/A | N/A | 9694 | 9713 | ATCTTGGGCCTACTCACTCA | 75 | 235 |
| 1218319 | N/A | N/A | 9861 | 9880 | TCCCCCGGACAAAGAAGCCT | 50 | 236 |
| 1218323 | N/A | N/A | 10520 | 10539 | AGTGAGTCCTATTACCCACC | 45 | 237 |
| 1218327 | N/A | N/A | 11121 | 11140 | TCCAAGTACTAGTCCCATGC | 27 | 238 |
| 1218331 | N/A | N/A | 11463 | 11482 | GAGGTTTGATATTACTCCCA | 29 | 239 |

TABLE 3-continued

Reduction of PLP1 RNA by 5-10-5 MOE gapmers with phosphorothioate internucleoside linkages in SK-MEL-28 cells

| Compound ID | SEQ ID NO: 1 Start Site | SEQ ID NO: 1 Stop Site | SEQ ID NO: 2 Start Site | SEQ ID NO: 2 Stop Site | Sequence (5' to 3') | PLP1 (% UTC) | SEQ ID No. |
|---|---|---|---|---|---|---|---|
| 1218335 | N/A | N/A | 13022 | 13041 | GCAATATGAACCACACCTAG | 42 | 240 |
| 1218339 | N/A | N/A | 13230 | 13249 | CGCCACACCTTGCTTACCCT | 55 | 241 |
| 1218343 | N/A | N/A | 13747 | 13766 | CCACCCCTTGTTATTGCCAC | 40 | 242 |
| 1218347 | N/A | N/A | 13769 | 13788 | CAGACTCGCGCCCAATTTTC | 62 | 243 |
| 1218351 | N/A | N/A | 13969 | 13988 | GGTCTGATTGTACAAAGCAT | 22 | 244 |
| 1218355 | N/A | N/A | 14042 | 14061 | TGTCCAGTTAGATCCACTCT | 8 | 245 |
| 1218359 | N/A | N/A | 14289 | 14308 | CGCCAAAGGATCTTTAACTC | 30 | 246 |
| 1218363 | N/A | N/A | 14962 | 14981 | CGTACCCTAACTCACCATAC | 77† | 247 |
| 1218367 | N/A | N/A | 14966 | 14985 | CACCCGTACCCTAACTCACC | 64† | 248 |
| 1218371 | N/A | N/A | 15541 | 15560 | TGTATGGTATTAGCTACTCC | 23 | 249 |
| 1218375 | N/A | N/A | 15992 | 16011 | CTGTCTCCCCCGGATTTACT | 46 | 250 |
| 1218379 | N/A | N/A | 16434 | 16453 | TACCCACACTATCTCAGGCC | 23 | 251 |
| 1218383 | N/A | N/A | 16938 | 16957 | GCACACTACATTCACAGGGC | 17 | 252 |
| 1218387 | N/A | N/A | 17196 | 17215 | CCACATCAATATGTCCGAGT | 12 | 253 |

TABLE 4

Reduction of PLP1 RNA by 5-10-5 MOE gapmers with phosphorothioate internucleoside linkages in SK-MEL-28 cells

| Compound ID | SEQ ID NO: 1 Start Site | SEQ ID NO: 1 Stop Site | SEQ ID NO: 2 Start Site | SEQ ID NO: 2 Stop Site | Sequence (5' to 3') | PLP1 (% UTC) | SEQ ID No. |
|---|---|---|---|---|---|---|---|
| 1218080 | N/A | N/A | 3814 | 3833 | CTGATTGACAGCCAACCCCC | 98 | 254 |
| 1218084 | 236 | 255 | 3946 | 3965 | GGCTGGCTAGTCTGCTTTGT | 41 | 255 |
| 1218088 | 248 | 267 | 3958 | 3977 | CCAATTGTAGCCGGCTGGCT | 62 | 256 |
| 1218092 | 253 | 272 | 3963 | 3982 | TGACTCCAATTGTAGCCGGC | 80 | 257 |
| 1218096 | 550 | 569 | 13538 | 13557 | CCGGTGGTGTAGAAGCCCTC | 65 | 258 |
| 1218100 | 562 | 581 | 13550 | 13569 | TGCCTGACTGCGCCGGTGGT | 37 | 259 |
| 1218104 | 576 | 595 | 13564 | 13583 | AGTCGCCAAAGATCTGCCTG | 51 | 260 |
| 1218108 | 587 | 606 | 13575 | 13594 | GGTGGTCTTGTAGTCGCCAA | 44 | 261 |

TABLE 4-continued

Reduction of PLP1 RNA by 5-10-5 MOE gapmers with phosphorothioate internucleoside linkages in SK-MEL-28 cells

| Compound ID | SEQ ID NO: 1 Start Site | SEQ ID NO: 1 Stop Site | SEQ ID NO: 2 Start Site | SEQ ID NO: 2 Stop Site | Sequence (5' to 3') | PLP1 (% UTC) | SEQ ID No. |
|---|---|---|---|---|---|---|---|
| 1218112 | 595 | 614 | 13583 | 13602 | CCGCAGATGGTGGTCTTGTA | 50 | 262 |
| 1218116 | 603 | 622 | 13591 | 13610 | GGCCCTTGCCGCAGATGGTG | 52 | 263 |
| 1218120 | 612 | 631 | 13600 | 13619 | TTGCGCTCAGGCCCTTGCCG | 60 | 264 |
| 1218124 | 619 | 638 | 13607 | 13626 | GTTACCGTTGCGCTCAGGCC | 51 | 265 |
| 1218128 | 623 | 642 | 13611 | 13630 | CCCTGTTACCGTTGCGCTCA | 92 | 266 |
| 1218132 | 632 | 651 | 13620 | 13639 | CTTCTGGCCCCCTGTTACCG | 82 | 267 |
| 1218136 | 679 | 698 | 13667 | 13686 | ACCCGCTCCAAAGAATGAGC | 50 | 268 |
| 1218140 | 715 | 734 | 13703 | 13722 | TCGGGATGTCCTAGCCATTT | 31 | 269 |

TABLE 4-continued

Reduction of PLP1 RNA by 5-10-5 MOE gapmers with phosphorothioate internucleoside linkages in SK-MEL-28 cells

| Compound ID | SEQ ID NO: 1 Start Site | SEQ ID NO: 1 Stop Site | SEQ ID NO: 2 Start Site | SEQ ID NO: 2 Stop Site | Sequence (5' to 3') | PLP1 (% UTC) | SEQ ID No. |
|---|---|---|---|---|---|---|---|
| 1218144 | 755 | 774 | 14814 | 14833 | CCACACAACGGTCAGGGCAT | 41 | 270 |
| 1218148 | 763 | 782 | 14822 | 14841 | ACCAGGAGCCACACAACGGT | 54 | 271 |
| 1218152 | 866 | 885 | 14925 | 14944 | GAGACTGCCTATACTGGCAG | 83 | 272 |
| 1218156 | 1096 | 1115 | 17575 | 17594 | AACTTGGTGCCTCGGCCCAT | 23 | 273 |
| 1218160 | 1103 | 1122 | 17582 | 17601 | GGATCAGAACTTGGTGCCTC | 22 | 274 |
| 1218164 | 1149 | 1168 | 17628 | 17647 | TGTGTGGTTAGAGCCTCGCT | 21 | 275 |
| 1218168 | 1168 | 1187 | 17647 | 17666 | GAGACGCAGCATTGTAGGCT | 17 | 276 |
| 1218172 | 1452 | 1471 | 17931 | 17950 | TCAGTGGAAGTACCCTTTGA | 69 | 277 |
| 1218176 | 1681 | 1700 | 18160 | 18179 | AAGATCCTTGCTTTGACCCC | 61 | 278 |
| 1218180 | 1732 | 1751 | 18211 | 18230 | GGCTTCAGTAGTCCATCGCC | 16 | 279 |
| 1218184 | 1739 | 1758 | 18218 | 18237 | GAGTTAGGGCTTCAGTAGTC | 21 | 280 |
| 1218188 | 1760 | 1779 | 18239 | 18258 | ATGCTGTAAGTAAGGTTGGC | 19 | 281 |
| 1218192 | 1769 | 1788 | 18248 | 18267 | CGCTCCCTTATGCTGTAAGT | 17 | 282 |
| 1218196 | 1773 | 1792 | 18252 | 18271 | TCTACGCTCCCTTATGCTGT | 32 | 283 |
| 1218200 | 1781 | 1800 | 18260 | 18279 | ACACAGATTCTACGCTCCCT | 24 | 284 |
| 1218204 | 1785 | 1804 | 18264 | 18283 | GTCTACACAGATTCTACGCT | 19 | 285 |

TABLE 4-continued

Reduction of PLP1 RNA by 5-10-5 MOE gapmers with phosphorothioate internucleoside linkages in SK-MEL-28 cells

| Compound ID | SEQ ID NO: 1 Start Site | SEQ ID NO: 1 Stop Site | SEQ ID NO: 2 Start Site | SEQ ID NO: 2 Stop Site | Sequence (5' to 3') | PLP1 (% UTC) | SEQ ID No. |
|---|---|---|---|---|---|---|---|
| 1218208 | 1818 | 1837 | 18297 | 18316 | CCCTAACGAGGTGTAAGGCC | 8 | 286 |
| 1218212 | 1887 | 1906 | 18366 | 18385 | AGGGTTGTCATGGTAGCTGT | 22 | 287 |
| 1218216 | 1994 | 2013 | 18473 | 18492 | AGGGCCATCTCAGGTTACAC | 13 | 288 |
| 1218220 | 2141 | 2160 | 18620 | 18639 | GACCTTCAAATCACCTACGA | 17 | 289 |
| 1218224 | 2541 | 2560 | 19020 | 19039 | CCTGGAAGCTTACCAACTGA | 25 | 290 |
| 1218228 | 2879 | 2898 | 19358 | 19377 | ACGGATTACTTCACTGTCCT | 14 | 291 |
| 1218232 | 2883 | 2902 | 19362 | 19381 | AGGTACGGATTACTTCACTG | 20 | 292 |
| 1218236 | 30 | 49 | 3535 | 3554 | GGTCTAATTGGTGTGGGATA | 90 | 293 |
| 1218240 | 114 | 133 | 3619 | 3638 | CGCTTTGCTGCAGAGACATC | 93 | 294 |
| 1218244 | N/A | N/A | 974 | 993 | TCATTGTGTAGACTGAACTC | 91 | 295 |
| 1218248 | N/A | N/A | 1400 | 1419 | CCTCATAGGGTATCTTCCCA | 105 | 296 |
| 1218252 | N/A | N/A | 2020 | 2039 | ATCGCCAAATGTGTCTCCTC | 100 | 297 |
| 1218256 | N/A | N/A | 2563 | 2582 | GGTATGGTCTCCTGGAACTT | 104 | 298 |
| 1218260 | N/A | N/A | 3444 | 3463 | GCTCCCAAAGTCCTTCCGAA | 104 | 299 |
| 1218264 | N/A | N/A | 4366 | 4385 | GGCTAGACAGTGCTCAGTGG | 40 | 300 |
| 1218268 | N/A | N/A | 5141 | 5160 | GGTGATTCAGTGACCTGTCC | 39 | 301 |

TABLE 4-continued

Reduction of PLP1 RNA by 5-10-5 MOE gapmers with phosphorothioate internucleoside linkages in SK-MEL-28 cells

| Compound ID | SEQ ID NO: 1 Start Site | SEQ ID NO: 1 Stop Site | SEQ ID NO: 2 Start Site | SEQ ID NO: 2 Stop Site | Sequence (5' to 3') | PLP1 (% UTC) | SEQ ID No. |
|---|---|---|---|---|---|---|---|
| 1218272 | N/A | N/A | 5473 | 5492 | ACCTATCCAGTCAGCTCGGC | 85 | 302 |
| 1218276 | N/A | N/A | 5793 | 5812 | GTCCAGTACCTTGTTAGAGA | 29 | 303 |
| 1218280 | N/A | N/A | 5956 | 5975 | GCAGAGGCTGTACGAACATT | 29 | 304 |
| 1218284 | N/A | N/A | 6350 | 6369 | GCTACACCCACTTACTGCAA | 45 | 305 |
| 1218288 | N/A | N/A | 6780 | 6799 | GAGTTCTACCTTAATGGGTT | 57 | 306 |
| 1218292 | N/A | N/A | 7468 | 7487 | CACTCCTCTTCAGACGCGCA | 69 | 307 |
| 1218296 | N/A | N/A | 7636 | 7655 | AGTGCTGGAAAACAGTCCCG | 69 | 308 |
| 1218300 | N/A | N/A | 7949 | 7968 | GGTCTCGAATCTGCACTACA | 50 | 309 |

TABLE 4-continued

Reduction of PLP1 RNA by 5-10-5 MOE gapmers with phosphorothioate internucleoside linkages in SK-MEL-28 cells

| Compound ID | SEQ ID NO: 1 Start Site | SEQ ID NO: 1 Stop Site | SEQ ID NO: 2 Start Site | SEQ ID NO: 2 Stop Site | Sequence (5' to 3') | PLP1 (% UTC) | SEQ ID No. |
|---|---|---|---|---|---|---|---|
| 1218304 | N/A | N/A | 8273 | 8292 | TCAAGGGACTGTGTTGATCC | 63 | 310 |
| 1218308 | N/A | N/A | 8959 | 8978 | GGTATGTGTGAACAATAGCC | 56 | 311 |
| 1218312 | N/A | N/A | 9521 | 9540 | TGAGTGTATCTGATCCCTCA | 45 | 312 |
| 1218316 | N/A | N/A | 9709 | 9728 | CCCTAGCAAGTGACCATCTT | 90 | 313 |
| 1218320 | N/A | N/A | 9868 | 9887 | CCATAGCTCCCCCGGACAAA | 77 | 314 |
| 1218324 | N/A | N/A | 10522 | 10541 | GGAGTGAGTCCTATTACCCA | 49 | 315 |
| 1218328 | N/A | N/A | 11125 | 11144 | GTGTTCCAAGTACTAGTCCC | 58 | 316 |
| 1218332 | N/A | N/A | 11464 | 11483 | GGAGGTTTGATATTACTCCC | 50 | 317 |

TABLE 4-continued

Reduction of PLP1 RNA by 5-10-5 MOE gapmers with phosphorothioate internucleoside linkages in SK-MEL-28 cells

| Compound ID | SEQ ID NO: 1 Start Site | SEQ ID NO: 1 Stop Site | SEQ ID NO: 2 Start Site | SEQ ID NO: 2 Stop Site | Sequence (5' to 3') | PLP1 (% UTC) | SEQ ID No. |
|---|---|---|---|---|---|---|---|
| 1218336 | N/A | N/A | 13056 | 13075 | CTCCATACCTACTACGCTGG | 48 | 318 |
| 1218340 | N/A | N/A | 13361 | 13380 | CCAGAGCGAGCACCTTAACA | 55 | 319 |
| 1218344 | N/A | N/A | 13762 | 13781 | GCGCCCAATTTTCCCCCACC | 46 | 320 |
| 1218348 | N/A | N/A | 13776 | 13795 | GAGGCCACAGACTCGCGCCC | 55 | 321 |
| 1218352 | N/A | N/A | 14037 | 14056 | AGTTAGATCCACTCTTGTGG | 36 | 322 |
| 1218356 | N/A | N/A | 14043 | 14062 | TTGTCCAGTTAGATCCACTC | 23 | 323 |
| 1218360 | N/A | N/A | 14402 | 14421 | TGTTCCCTAGCCATTGAACA | 67 | 324 |
| 1218364 | N/A | N/A | 14963 | 14982 | CCGTACCCTAACTCACCATA | 94† | 325 |
| 1218368 | N/A | N/A | 15173 | 15192 | GTAGGCCAATGTGAATGGCC | 95 | 326 |
| 1218372 | N/A | N/A | 15542 | 15561 | TTGTATGGTATTAGCTACTC | 45 | 327 |
| 1218376 | N/A | N/A | 16130 | 16149 | TGGCCCATTAACACCCAGAT | 49 | 328 |
| 1218380 | N/A | N/A | 16529 | 16548 | GTACGGAGCCTCCACCCTTT | 50 | 329 |
| 1218384 | N/A | N/A | 17128 | 17147 | AGTAGAGCTCTCCCCTGGTT | 66 | 330 |
| 1218388 | N/A | N/A | 17329 | 17348 | AGTCCGATGTCTCTGAGGCA | 42 | 331 |

Example 2: Effect of 5-10-5 MOE Gapmer Modified Oligonucleotides on Human PLP1 RNA In Vitro, Single Dose Modified oligonucleotides complementary to human PLP1 nucleic acid were designed and tested for their single dose effects on PLP1 RNA in vitro. The modified oligonucleotides were tested in a series of experiments that had the same culture conditions, and the results for each experiment are presented in separate tables below.

The modified oligonucleotides in the tables below are 5-10-5 MOE gapmers. The gapmers are 20 nucleosides in length, wherein the central gap segment consists of ten 2'-β-D-deoxynucleosides and the 5' and 3' wing segments each consists of five 2'-MOE modified nucleosides. The sugar motif for the gapmers is (from 5' to 3'):

eeeeeddddddddddeeeee; wherein ‘d’ represents a 2'-β-D-deoxyribosyl sugar moiety, and ‘e’ represents a 2'-MOE sugar moiety. The internucleoside linkage motif for the gapmers is (from 5' to 3'): “sooosssssssssssooss”; wherein each ‘o’ represents a phosphodiester internucleoside linkage and each ‘s’ represents a phosphorothioate internucleoside linkage.

Each cytosine residue is a 5-methyl cytosine. “Start site” indicates the 5'-most nucleoside to which the modified oligonucleotide is complementary in the target nucleic acid sequence. “Stop site” indicates the 3'-most nucleoside to which the modified oligonucleotide is complementary in the target nucleic acid sequence. Each modified oligonucleotide listed in the Tables below is 100% complementary to either human PLP1 mRNA (SEQ ID NO: 1) or to the human PLP1 genomic sequence (SEQ TD NO: 2), or to both. ‘N/A’ indicates that the modified oligonucleotide is not 100% complementary to that particular target nucleic acid sequence.

Cultured SK-MEL-28 cells were treated with modified oligonucleotide at a concentration of 4,000 nM using electroporation at a density of 20,000 cells per well. After a treatment period of approximately 24 hours, total RNA was isolated from the cells and PLP1 RNA levels were measured by quantitative real-time RTPCR. PLP1 RNA levels were measured by Human PLP1 primer probe set RTS35092, described in Example 1 above. PLP1 RNA levels were normalized to total RNA content, as measured by RIBOGREEN®. Reduction of PLP1 RNA is presented in the tables below as percent PLP1 RNA relative to the amount in untreated control cells (% UTC). Each table represents results from an individual assay plate. The values marked with an “T” indicate that the modified oligonucleotide is complementary to the amplicon region of the primer probe set. Additional assays may be used to measure the potency and efficacy of the modified oligonucleotides complementary to the amplicon region.

TABLE 5

Reduction of PLP1 RNA by 5-10-5 MOE gapmers with mixed PO/PS internucleoside linkages in SK-MEL-28 cells

| Compound ID | SEQ ID NO: 1 Start Site | SEQ ID NO: 1 Stop Site | SEQ ID NO: 2 Start Site | SEQ ID NO: 2 Stop Site | Sequence (5' to 3') | PLP1 (% UTC) | SEQ ID No. |
|---|---|---|---|---|---|---|---|
| 1362432 | N/A | N/A | 8998 | 9017 | GCTCCCTTTGATTTTTCACA | 37 | 332 |
| 1362464 | 2489 | 2508 | 18968 | 18987 | TCTATATCAGGAGAAAATAA | 62 | 333 |

TABLE 5-continued

Reduction of PLP1 RNA by 5-10-5 MOE gapmers with mixed PO/PS internucleoside linkages in SK-MEL-28 cells

| Compound ID | SEQ ID NO: 1 Start Site | SEQ ID NO: 1 Stop Site | SEQ ID NO: 2 Start Site | SEQ ID NO: 2 Stop Site | Sequence (5' to 3') | PLP1 (% UTC) | SEQ ID No. |
|---|---|---|---|---|---|---|---|
| 1362490 | 1731 | 1750 | 18210 | 18229 | GCTTCAGTAGTCCATCGCCA | 20 | 201 |
| 1362496 | 1917 | 1936 | 18396 | 18415 | TCCTTCTATTCTCAGCTCCT | 15 | 334 |
| 1362567 | 1879 | 1898 | 18358 | 18377 | CATGGTAGCTGTTATCAAGG | 21 | 335 |
| 1362568 | 2408 | 2427 | 18887 | 18906 | CATTAGCTAGAAAGAACGAT | 33 | 336 |
| 1362595 | N/A | N/A | 16249 | 16268 | CATGAATACAGCTTTCTGAA | 47 | 337 |
| 1362652 | 2080 | 2099 | 18559 | 18578 | AAGATATGACAGAGGCCAGA | 30 | 338 |
| 1362658 | 1217 | 1236 | 17696 | 17715 | TCAAGTAAGAAGAGGGCCAG | 56 | 339 |
| 1362661 | N/A | N/A | 10078 | 10097 | AGATTCAGCCTATAAGTCAA | 53 | 340 |

TABLE 5-continued

Reduction of PLP1 RNA by 5-10-5 MOE gapmers with mixed PO/PS internucleoside linkages in SK-MEL-28 cells

| Compound ID | SEQ ID NO: 1 Start Site | SEQ ID NO: 1 Stop Site | SEQ ID NO: 2 Start Site | SEQ ID NO: 2 Stop Site | Sequence (5' to 3') | PLP1 (% UTC) | SEQ ID No. |
|---|---|---|---|---|---|---|---|
| 1362687 | N/A | N/A | 9225 | 9244 | CAATTCAGTAATATCAGCAT | 55 | 341 |
| 1362731 | 2016 | 2035 | 18495 | 18514 | TTATCTATCCTGTGTCTACC | 49 | 342 |
| 1362740 | 2300 | 2319 | 18779 | 18798 | CAATTTTTAATATCATTTGT | 57 | 343 |
| 1362755 | 2844 | 2863 | 19323 | 19342 | TCTTACAAAACATTTTCCCT | 40 | 344 |
| 1362763 | 2350 | 2369 | 18829 | 18848 | TTTCTGCAAAGGCAGAATAC | 58 | 345 |
| 1362775 | 2325 | 2344 | 18804 | 18823 | GAAAATCCCAATAGATTCAA | 49 | 346 |
| 1362803 | 2159 | 2178 | 18638 | 18657 | CATTCTAAAACAAATCAAGA | 68 | 347 |
| 1362827 | N/A | N/A | 11747 | 11766 | CTAACAATTCAGGCAGCCAA | 57 | 348 |
| 1362850 | N/A | N/A | 17152 | 17171 | TGTAGACACACAGCCACATC | 57 | 349 |
| 1362884 | 1439 | 1458 | 17918 | 17937 | CCTTTGAGAAGAAATTACTT | 70 | 350 |
| 1362923 | 1254 | 1273 | 17733 | 17752 | TTAATCACTGCAAGACTCTC | 51 | 351 |
| 1362925 | N/A | N/A | 16906 | 16925 | TCAGCAAGACCTGGGACATA | 39 | 352 |
| 1362979 | N/A | N/A | 8166 | 8185 | CCATGATGGAAATTCAGTGT | 58 | 353 |
| 1363002 | 2699 | 2718 | 19178 | 19197 | AACACAACTCTTTACAACAA | 49 | 354 |
| 1363018 | N/A | N/A | 13294 | 13313 | TCACCTTATCTTTGTTGAAA | 55 | 355 |
| 1363035 | 1052 | 1071 | 17531 | 17550 | AGTGGCAGCAATCATGAAGG | 35 | 356 |

TABLE 5-continued

Reduction of PLP1 RNA by 5-10-5 MOE gapmers with mixed PO/PS internucleoside linkages in SK-MEL-28 cells

| Compound ID | SEQ ID NO: 1 Start Site | SEQ ID NO: 1 Stop Site | SEQ ID NO: 2 Start Site | SEQ ID NO: 2 Stop Site | Sequence (5' to 3') | PLP1 (% UTC) | SEQ ID No. |
|---|---|---|---|---|---|---|---|
| 1363043 | N/A | N/A | 4770 | 4789 | TCTGAGTAGAAACTACCACC | 32 | 357 |
| 1363080 | 1843 | 1862 | 18322 | 18341 | ATGCTGACAACACCCTGTTT | 46 | 358 |
| 1363081 | N/A | N/A | 10740 | 10759 | GCCACACTCACTTTTCTATA | 48 | 359 |
| 1363103 | 1734 | 1753 | 18213 | 18232 | AGGGCTTCAGTAGTCCATCG | 11 | 46 |
| 1363134 | 1481 | 1500 | 17960 | 17979 | TGAGCATCTTTCCTTCCACT | 14 | 360 |
| 1363136 | 1520 | 1539 | 17999 | 18018 | TAGATGGCAAGAGGACCAAA | 70 | 361 |
| 1363137 | 2793 | 2812 | 19272 | 19291 | TTGTATACTGGTTTGAAAAC | 62 | 362 |
| 1363157 | 2752 | 2771 | 19231 | 19250 | AAAGCTCTTACATCTCCTTA | 27 | 363 |
| 1363158 | 2436 | 2455 | 18915 | 18934 | GATAACATTGCTAAGTAAAA | 42 | 364 |
| 1363161 | 3121 | 3140 | 19600 | 19619 | TTTGATTGAGAACATTCTTA | 43 | 365 |
| 1363177 | N/A | N/A | 5117 | 5136 | TCACATAGTTCATAAGTAGC | 40 | 366 |
| 1363206 | 1784 | 1803 | 18263 | 18282 | TCTACACAGATTCTACGCTC | 25 | 207 |
| 1363219 | 2135 | 2154 | 18614 | 18633 | CAAATCACCTACGATGACTG | 51 | 367 |
| 1363230 | N/A | N/A | 7394 | 7413 | CATTCCAATTTATGTGCAAG | 48 | 368 |
| 1363240 | 2237 | 2256 | 18716 | 18735 | TCAAAGAATTATTCTCCAGA | 42 | 369 |
| 1363259 | 2381 | 2400 | 18860 | 18879 | CTCAAATTGAGATTCAAATT | 59 | 370 |

TABLE 5-continued

Reduction of PLP1 RNA by 5-10-5 MOE gapmers with mixed PO/PS internucleoside linkages in SK-MEL-28 cells

| Compound ID | SEQ ID NO: 1 Start Site | SEQ ID NO: 1 Stop Site | SEQ ID NO: 2 Start Site | SEQ ID NO: 2 Stop Site | Sequence (5' to 3') | PLP1 (% UTC) | SEQ ID No. |
|---|---|---|---|---|---|---|---|
| 1363272 | 2994 | 3013 | 19473 | 19492 | ACTTTCAGTTGATTAACTCT | 37 | 371 |
| 1363291 | N/A | N/A | 13758 | 13777 | CCAATTTTCCCCCACCCCTT | 56 | 372 |
| 1363342 | 1137 | 1156 | 17616 | 17635 | GCCTCGCTATTAGAGAAAGG | 34 | 373 |
| 1363383 | 1298 | 1317 | 17777 | 17796 | TGACTAAAAGAGGTACATAA | 52 | 374 |
| 1363396 | N/A | N/A | 15298 | 15317 | CCAACAATCAGGATCCTCTT | 73 | 375 |
| 1363437 | N/A | N/A | 11123 | 11142 | GTTCCAAGTACTAGTCCCAT | 40 | 376 |
| 1363466 | N/A | N/A | 14343 | 14362 | CTAAGCTAACTGCTGGCCAC | 45 | 377 |
| 1363495 | 2262 | 2281 | 18741 | 18760 | TTCCTAGTTTAAAAAACAGT | 59 | 378 |
| 1363529 | N/A | N/A | 5830 | 5849 | TTGAACAGCAGTGCACTCCA | 69 | 379 |
| 1363539 | 1554 | 1573 | 18033 | 18052 | TTTTGTACACCAAAGAGAAT | 62 | 380 |
| 1363641 | N/A | N/A | 16661 | 16680 | GCAACATTACATGTTCTATA | 11 | 381 |
| 1363679 | N/A | N/A | 11910 | 11929 | CTTATTTTAGTCATTCATCA | 47 | 382 |
| 1363681 | 2894 | 2913 | 19373 | 19392 | AACAAAACACAAGGTACGGA | 20 | 383 |
| 1363730 | 1363 | 1382 | 17842 | 17861 | TGCAGTTGGGAAGTCATCTT | 36 | 384 |
| 1363734 | 2672 | 2691 | 19151 | 19170 | GTAGTACAAATCTTTCCTTC | 15 | 385 |
| 1363751 | 2624 | 2643 | 19103 | 19122 | TTTAACCCAAAGTTAACAAA | 50 | 386 |

TABLE 5-continued

Reduction of PLP1 RNA by 5-10-5 MOE gapmers with mixed PO/PS internucleoside linkages in SK-MEL-28 cells

| Compound ID | SEQ ID NO: 1 Start Site | SEQ ID NO: 1 Stop Site | SEQ ID NO: 2 Start Site | SEQ ID NO: 2 Stop Site | Sequence (5' to 3') | PLP1 (% UTC) | SEQ ID No. |
|---|---|---|---|---|---|---|---|
| 1363767 | 2107 | 2126 | 18586 | 18605 | ATACCCCATGAAATGAGCAC | 23 | 387 |
| 1363797 | 1403 | 1422 | 17882 | 17901 | TGCTTGAAAATTCAATTAGA | 45 | 388 |
| 1363843 | N/A | N/A | 8643 | 8662 | CAGTACAAGAATTAAGCACA | 41 | 389 |
| 1363858 | 1185 | 1204 | 17664 | 17683 | GCAAAGAGTTAAGATGGGAG | 27 | 390 |
| 1363892 | 1976 | 1995 | 18455 | 18474 | ACCATTAGCCACCAGCAACT | 47 | 391 |
| 1363900 | 2586 | 2605 | 19065 | 19084 | TCTGGGAGCTATTCAGGTCT | 19 | 392 |
| 1363907 | 3060 | 3079 | 19539 | 19558 | AAGTTTCTAAAAGTTTATCC | 29 | 393 |
| 1363921 | 1593 | 1612 | 18072 | 18091 | CTATCTTCAGTGGTAATAGA | 35 | 394 |
| 1363922 | N/A | N/A | 15670 | 15689 | GGTGTTTTACCTTCTATGCT | 73 | 395 |
| 1363937 | 1664 | 1683 | 18143 | 18162 | CCCCTTCTCCCAGCTGCAAT | 44 | 396 |
| 1363951 | 2535 | 2554 | 19014 | 19033 | AGCTTACCAACTGAATAGCT | 33 | 397 |
| 1363982 | 3022 | 3041 | 19501 | 19520 | GCAATTCTATATCAGAAATG | 21 | 398 |
| 1363998 | N/A | N/A | 7041 | 7060 | TTGATGTAAGTTTGGCACTG | 35 | 399 |
| 1364032 | 1324 | 1343 | 17803 | 17822 | TAGCAGGAACCAGCTATGAA | 56 | 400 |
| 1364046 | 2202 | 2221 | 18681 | 18700 | CCCAAATAAGTAATAAACAA | 46 | 401 |
| 1364111 | N/A | N/A | 6222 | 6241 | CAATGTTTTGCTGTTCAATA | 50 | 402 |

TABLE 5-continued

Reduction of PLP1 RNA by 5-10-5 MOE gapmers with mixed PO/PS internucleoside linkages in SK-MEL-28 cells

| Compound ID | SEQ ID NO: 1 Start Site | SEQ ID NO: 1 Stop Site | SEQ ID NO: 2 Start Site | SEQ ID NO: 2 Stop Site | Sequence (5' to 3') | PLP1 (% UTC) | SEQ ID No. |
|---|---|---|---|---|---|---|---|
| 1364117 | 2053 | 2072 | 18532 | 18551 | ACTAATTAACAGAAAAAAAG | 74 | 403 |
| 1364223 | N/A | N/A | 5446 | 5465 | AGATAGGATTCCTGATGTTA | 62 | 404 |
| 1364232 | 2462 | 2481 | 18941 | 18960 | GTTAAACCTAACTCTTAACA | 49 | 405 |
| 1364251 | N/A | N/A | 6414 | 6433 | TCAGTTAGTCTTCGGGCATT | 34 | 406 |

TABLE 6

Reduction of PLP1 RNA by 5-10-5 MOE gapmers with mixed PO/PS internucleoside linkages in SK-MEL-28 cells

| Compound ID | SEQ ID NO: 1 Start Site | SEQ ID NO: 1 Stop Site | SEQ ID NO: 2 Start Site | SEQ ID NO: 2 Stop Site | Sequence (5' to 3') | PLP1 (% UTC) | SEQ ID No. |
|---|---|---|---|---|---|---|---|
| 805577 | 1253 | 1272 | 17732 | 17751 | TAATCACTGCAAGACTCTCC | 35 | 407 |
| 1362428 | N/A | N/A | 7391 | 7410 | TCCAATTTATGTGCAAGCAT | 24 | 408 |
| 1362431 | 2488 | 2507 | 18967 | 18986 | CTATATCAGGAGAAAATAAC | 50 | 409 |
| 1362443 | N/A | N/A | 6215 | 6234 | TTGCTGTTCAATAATGGCAT | 26 | 410 |
| 1362449 | 2698 | 2717 | 19177 | 19196 | ACACAACTCTTTACAACAAA | 16 | 411 |
| 1362490 | 1731 | 1750 | 18210 | 18229 | GCTTCAGTAGTCCATCGCCA | 13 | 201 |
| 1362498 | N/A | N/A | 5445 | 5464 | GATAGGATTCCTGATGTTAC | 48 | 412 |
| 1362508 | N/A | N/A | 5115 | 5134 | ACATAGTTCATAAGTAGCAG | 29 | 413 |
| 1362623 | 1780 | 1799 | 18259 | 18278 | CACAGATTCTACGCTCCCTT | 16 | 414 |
| 1362629 | N/A | N/A | 13281 | 13300 | GTTGAAATAAGTGAAGACAG | 53 | 415 |
| 1362670 | 2671 | 2690 | 19150 | 19169 | TAGTACAAATCTTTCCTTCA | 18 | 416 |
| 1362677 | 2893 | 2912 | 19372 | 19391 | ACAAAACACAAGGTACGGAT | 21 | 417 |
| 1362711 | 2435 | 2454 | 18914 | 18933 | ATAACATTGCTAAGTAAAAT | 77 | 418 |
| 1362718 | 2008 | 2027 | 18487 | 18506 | CCTGTGTCTACCAGAGGGCC | 21 | 419 |
| 1362750 | 1662 | 1681 | 18141 | 18160 | CCTTCTCCCAGCTGCAATAG | 30 | 420 |
| 1362756 | N/A | N/A | 16905 | 16924 | CAGCAAGACCTGGGACATAG | 33 | 421 |
| 1362765 | N/A | N/A | 5828 | 5847 | GAACAGCAGTGCACTCCACA | 36 | 422 |
| 1362766 | 1323 | 1342 | 17802 | 17821 | AGCAGGAACCAGCTATGAAG | 33 | 423 |
| 1362809 | 2236 | 2255 | 18715 | 18734 | CAAAGAATTATTCTCCAGAC | 23 | 424 |
| 1362812 | 3119 | 3138 | 19598 | 19617 | TGATTGAGAACATTCTTAAT | 48 | 425 |

TABLE 6-continued

Reduction of PLP1 RNA by 5-10-5 MOE gapmers with mixed PO/PS internucleoside linkages in SK-MEL-28 cells

| Compound ID | SEQ ID NO: 1 Start Site | SEQ ID NO: 1 Stop Site | SEQ ID NO: 2 Start Site | SEQ ID NO: 2 Stop Site | Sequence (5' to 3') | PLP1 (% UTC) | SEQ ID No. |
|---|---|---|---|---|---|---|---|
| 1362839 | N/A | N/A | 13743 | 13762 | CCCTTGTTATTGCCACAAAA | 32 | 426 |
| 1362880 | 2843 | 2862 | 19322 | 19341 | CTTACAAAACATTTTCCCTC | 30 | 427 |
| 1362922 | 2461 | 2480 | 18940 | 18959 | TTAAACCTAACTCTTAACAC | 50 | 428 |
| 1362933 | 1553 | 1572 | 18032 | 18051 | TTTGTACACCAAAGAGAATA | 50 | 429 |
| 1362995 | 1591 | 1610 | 18070 | 18089 | ATCTTCAGTGGTAATAGAGA | 34 | 430 |
| 1363011 | N/A | N/A | 4769 | 4788 | CTGAGTAGAAACTACCACCA | 27 | 431 |
| 1363046 | N/A | N/A | 16597 | 16616 | TCCTCATACCACTTTTCTTG | 87 | 432 |
| 1363055 | 1216 | 1235 | 17695 | 17714 | CAAGTAAGAAGAGGGCCAGT | 69 | 433 |
| 1363058 | 2380 | 2399 | 18859 | 18878 | TCAAATTGAGATTCAAATTC | 63 | 434 |
| 1363110 | 3021 | 3040 | 19500 | 19519 | CAATTCTATATCAGAAATGA | 35 | 435 |
| 1363121 | 1732 | 1751 | 18211 | 18230 | GGCTTCAGTAGTCCATCGCC | 11 | 279 |
| 1363140 | 1361 | 1380 | 17840 | 17859 | CAGTTGGGAAGTCATCTTCT | 27 | 436 |
| 1363170 | 2534 | 2553 | 19013 | 19032 | GCTTACCAACTGAATAGCTG | 18 | 437 |
| 1363176 | 2079 | 2098 | 18558 | 18577 | AGATATGACAGAGGCCAGAG | 32 | 438 |
| 1363184 | 1874 | 1893 | 18353 | 18372 | TAGCTGTTATCAAGGAGAAG | 11 | 439 |
| 1363188 | 1519 | 1538 | 17998 | 18017 | AGATGGCAAGAGGACCAAAG | 34 | 440 |
| 1363209 | 1051 | 1070 | 17530 | 17549 | GTGGCAGCAATCATGAAGGT | 23 | 441 |
| 1363223 | 1297 | 1316 | 17776 | 17795 | GACTAAAAGAGGTACATAAG | 39 | 442 |
| 1363224 | N/A | N/A | 9224 | 9243 | AATTCAGTAATATCAGCATA | 71 | 443 |
| 1363225 | N/A | N/A | 16248 | 16267 | ATGAATACAGCTTTCTGAAT | 64 | 444 |
| 1363244 | 3059 | 3078 | 19538 | 19557 | AGTTTCTAAAAGTTTATCCT | 19 | 445 |
| 1363263 | 2261 | 2280 | 18740 | 18759 | TCCTAGTTTAAAAAACAGTC | 21 | 446 |
| 1363264 | N/A | N/A | 6399 | 6418 | GCATTTTATAAAACTGGACC | 40 | 447 |
| 1363279 | 2158 | 2177 | 18637 | 18656 | ATTCTAAAACAAATCAAGAC | 63 | 448 |
| 1363331 | 1436 | 1455 | 17915 | 17934 | TTGAGAAGAAATTACTTTCT | 64 | 449 |
| 1363332 | 2583 | 2602 | 19062 | 19081 | GGGAGCTATTCAGGTCTCAA | 88 | 135 |
| 1363350 | N/A | N/A | 10033 | 10052 | ACTGCCATTTTCCTTCTCTG | 34 | 450 |
| 1363354 | 1184 | 1203 | 17663 | 17682 | CAAAGAGTTAAGATGGGAGA | 44 | 451 |
| 1363362 | N/A | N/A | 7027 | 7046 | GCACTGAGTAGGCTCTGAAA | 18 | 452 |
| 1363388 | N/A | N/A | 15221 | 15240 | TGTTATTGAAATGTGCTGCT | 47 | 453 |
| 1363416 | N/A | N/A | 15669 | 15688 | GTGTTTTACCTTCTATGCTC | 27 | 454 |
| 1363510 | 2407 | 2426 | 18886 | 18905 | ATTAGCTAGAAAGAACGATC | 19 | 455 |
| 1363545 | 1975 | 1994 | 18454 | 18473 | CCATTAGCCACCAGCAACTG | 40 | 456 |
| 1363634 | N/A | N/A | 11120 | 11139 | CCAAGTACTAGTCCCATGCT | 48 | 457 |
| 1363645 | 2623 | 2642 | 19102 | 19121 | TTAACCCAAAGTTAACAAAA | 56 | 458 |

TABLE 6-continued

Reduction of PLP1 RNA by 5-10-5 MOE gapmers with mixed PO/PS internucleoside linkages in SK-MEL-28 cells

| Compound ID | SEQ ID NO: 1 Start Site | SEQ ID NO: 1 Stop Site | SEQ ID NO: 2 Start Site | SEQ ID NO: 2 Stop Site | Sequence (5' to 3') | PLP1 (% UTC) | SEQ ID No. |
|---|---|---|---|---|---|---|---|
| 1363687 | 1842 | 1861 | 18321 | 18340 | TGCTGACAACACCCTGTTTC | 28 | 459 |
| 1363736 | 1136 | 1155 | 17615 | 17634 | CCTCGCTATTAGAGAAAGGG | 13 | 460 |
| 1363755 | 2201 | 2220 | 18680 | 18699 | CCAAATAAGTAATAAACAAA | 60 | 461 |
| 1363761 | 1402 | 1421 | 17881 | 17900 | GCTTGAAAATTCAATTAGAG | 17 | 462 |
| 1363798 | N/A | N/A | 8641 | 8660 | GTACAAGAATTAAGCACACT | 38 | 463 |
| 1363806 | 2349 | 2368 | 18828 | 18847 | TTCTGCAAAGGCAGAATACT | 63 | 464 |
| 1363823 | 2134 | 2153 | 18613 | 18632 | AAATCACCTACGATGACTGA | 45 | 465 |
| 1363851 | N/A | N/A | 8994 | 9013 | CCTTTGATTTTTCACAGTCC | 28 | 466 |
| 1363882 | 2750 | 2769 | 19229 | 19248 | AGCTCTTACATCTCCTTAAA | 16 | 467 |
| 1363930 | 2324 | 2343 | 18803 | 18822 | AAAATCCCAATAGATTCAAC | 29 | 468 |
| 1363932 | 2792 | 2811 | 19271 | 19290 | TGTATACTGGTTTGAAAACA | 32 | 469 |
| 1363934 | N/A | N/A | 8160 | 8179 | TGGAAATTCAGTGTGAATCT | 37 | 470 |
| 1363959 | 2106 | 2125 | 18585 | 18604 | TACCCCATGAAATGAGCACC | 13 | 471 |
| 1364007 | 1916 | 1935 | 18395 | 18414 | CCTTCTATTCTCAGCTCCTT | 14 | 472 |
| 1364041 | N/A | N/A | 14308 | 14327 | GAACCCACACATGTTCAGCC | 17 | 473 |
| 1364067 | N/A | N/A | 11746 | 11765 | TAACAATTCAGGCAGCCAAG | 38 | 474 |
| 1364100 | N/A | N/A | 17151 | 17170 | GTAGACACACAGCCACATCA | 31 | 475 |
| 1364146 | 2052 | 2071 | 18531 | 18550 | CTAATTAACAGAAAAAAAGA | 107 | 476 |
| 1364156 | 2299 | 2318 | 18778 | 18797 | AATTTTTAATATCATTTGTG | 71 | 477 |
| 1364174 | N/A | N/A | 10688 | 10707 | TTCTGTTAACATTAGTTACA | 30 | 478 |
| 1364235 | 1478 | 1497 | 17957 | 17976 | GCATCTTTCCTTCCACTTTG | 13 | 479 |
| 1364240 | N/A | N/A | 11907 | 11926 | ATTTTAGTCATTCATCAACT | 43 | 480 |
| 1364269 | 2993 | 3012 | 19472 | 19491 | CTTTCAGTTGATTAACTCTC | 17 | 481 |

TABLE 7

Reduction of PLP1 RNA by 5-10-5 MOE gapmers with mixed PO/PS internucleoside linkages in SK-MEL-28 cells

| Compound ID | SEQ ID NO: 1 Start Site | SEQ ID NO: 1 Stop Site | SEQ ID NO: 2 Start Site | SEQ ID NO: 2 Stop Site | Sequence (5' to 3') | PLP1 (% UTC) | SEQ ID No. |
|---|---|---|---|---|---|---|---|
| 1362427 | N/A | N/A | 7390 | 7409 | CCAATTTATGTGCAAGCATT | 34 | 482 |
| 1362453 | 1551 | 1570 | 18030 | 18049 | TGTACACCAAAGAGAATATA | 43 | 483 |
| 1362467 | N/A | N/A | 4548 | 4567 | CTACCCATATCTGTTTCCCA | 60 | 484 |
| 1362468 | 1841 | 1860 | 18320 | 18339 | GCTGACAACACCCTGTTTCT | 21 | 485 |
| 1362481 | N/A | N/A | 5826 | 5845 | ACAGCAGTGCACTCCACATC | 59 | 486 |
| 1362490 | 1731 | 1750 | 18210 | 18229 | GCTTCAGTAGTCCATCGCCA | 11 | 201 |

TABLE 7-continued

Reduction of PLP1 RNA by 5-10-5 MOE gapmers with mixed PO/PS internucleoside linkages in SK-MEL-28 cells

| Compound ID | SEQ ID NO: 1 Start Site | SEQ ID NO: 1 Stop Site | SEQ ID NO: 2 Start Site | SEQ ID NO: 2 Stop Site | Sequence (5' to 3') | PLP1 (% UTC) | SEQ ID No. |
|---|---|---|---|---|---|---|---|
| 1362500 | 1049 | 1068 | 17528 | 17547 | GGCAGCAATCATGAAGGTGA | 19 | 487 |
| 1362524 | N/A | N/A | 7024 | 7043 | CTGAGTAGGCTCTGAAAGCA | 66 | 488 |
| 1362566 | 2460 | 2479 | 18939 | 18958 | TAAACCTAACTCTTAACACA | 51 | 489 |
| 1362577 | 1913 | 1932 | 18392 | 18411 | TCTATTCTCAGCTCCTTGGA | 38 | 490 |
| 1362578 | 1473 | 1492 | 17952 | 17971 | TTTCCTTCCACTTTGTTTCC | 60 | 491 |
| 1362604 | N/A | N/A | 16191 | 16210 | TAACTAAGTTTTCACTTCCC | 88 | 492 |
| 1362613 | N/A | N/A | 16540 | 16559 | TGCAAGTAGAAGTACGGAGC | 34 | 493 |
| 1362621 | N/A | N/A | 9221 | 9240 | TCAGTAATATCAGCATAAGC | 43 | 494 |
| 1362636 | 1215 | 1234 | 17694 | 17713 | AAGTAAGAAGAGGGCCAGTT | 63 | 495 |
| 1362641 | 2791 | 2810 | 19270 | 19289 | GTATACTGGTTTGAAAACAA | 14 | 496 |
| 1362650 | 1183 | 1202 | 17662 | 17681 | AAAGAGTTAAGATGGGAGAC | 61 | 497 |
| 1362690 | N/A | N/A | 9918 | 9937 | CCACTGTTCCCTTTCTCCCC | 94 | 498 |
| 1362704 | 2007 | 2026 | 18486 | 18505 | CTGTGTCTACCAGAGGGCCA | 24 | 499 |
| 1362706 | N/A | N/A | 11119 | 11138 | CAAGTACTAGTCCCATGCTC | 62 | 500 |
| 1362822 | 3058 | 3077 | 19537 | 19556 | GTTTCTAAAAGTTTATCCTT | 26 | 501 |
| 1362831 | 2433 | 2452 | 18912 | 18931 | AACATTGCTAAGTAAAATCA | 43 | 502 |
| 1362955 | 1777 | 1796 | 18256 | 18275 | AGATTCTACGCTCCCTTATG | 53 | 503 |
| 1362957 | 1661 | 1680 | 18140 | 18159 | CTTCTCCCAGCTGCAATAGG | 36 | 504 |
| 1362980 | N/A | N/A | 10680 | 10699 | ACATTAGTTACAGTTTGTTT | 48 | 505 |
| 1362987 | 1873 | 1892 | 18352 | 18371 | AGCTGTTATCAAGGAGAAGG | 16 | 506 |
| 1363016 | N/A | N/A | 5114 | 5133 | CATAGTTCATAAGTAGCAGA | 37 | 507 |
| 1363061 | N/A | N/A | 15220 | 15239 | GTTATTGAAATGTGCTGCTT | 62 | 508 |
| 1363071 | N/A | N/A | 11738 | 11757 | CAGGCAGCCAAGTAAGTGGT | 36 | 509 |
| 1363121 | 1732 | 1751 | 18211 | 18230 | GGCTTCAGTAGTCCATCGCC | 13 | 279 |
| 1363165 | 1518 | 1537 | 17997 | 18016 | GATGGCAAGAGGACCAAAGA | 39 | 510 |
| 1363174 | 2379 | 2398 | 18858 | 18877 | CAAATTGAGATTCAAATTCA | 80 | 511 |
| 1363182 | 1296 | 1315 | 17775 | 17794 | ACTAAAAGAGGTACATAAGA | 82 | 512 |
| 1363243 | N/A | N/A | 14287 | 14306 | CCAAAGGATCTTTAACTCCA | 42 | 513 |
| 1363276 | 1322 | 1341 | 17801 | 17820 | GCAGGAACCAGCTATGAAGC | 50 | 514 |
| 1363300 | 3020 | 3039 | 19499 | 19518 | AATTCTATATCAGAAATGAA | 84 | 515 |
| 1363308 | N/A | N/A | 11904 | 11923 | TTAGTCATTCATCAACTATT | 36 | 516 |
| 1363344 | N/A | N/A | 16863 | 16882 | TTCTAATAATGTTAGGAGGT | 27 | 517 |
| 1363410 | 2105 | 2124 | 18584 | 18603 | ACCCCATGAAATGAGCACCA | 14 | 518 |
| 1363425 | 2892 | 2911 | 19371 | 19390 | CAAAACACAAGGTACGGATT | 48 | 519 |
| 1363434 | N/A | N/A | 15661 | 15680 | CCTTCTATGCTCATTGGCTC | 65 | 520 |

TABLE 7-continued

Reduction of PLP1 RNA by 5-10-5 MOE gapmers with mixed PO/PS internucleoside linkages in SK-MEL-28 cells

| Compound ID | SEQ ID NO: 1 Start Site | SEQ ID NO: 1 Stop Site | SEQ ID NO: 2 Start Site | SEQ ID NO: 2 Stop Site | Sequence (5' to 3') | PLP1 (% UTC) | SEQ ID No. |
|---|---|---|---|---|---|---|---|
| 1363439 | 1099 | 1118 | 17578 | 17597 | CAGAACTTGGTGCCTCGGCC | 15 | 40 |
| 1363443 | N/A | N/A | 5441 | 5460 | GGATTCCTGATGTTACCCAG | 41 | 521 |
| 1363542 | N/A | N/A | 6211 | 6230 | TGTTCAATAATGGCATTGTG | 50 | 522 |
| 1363550 | 2582 | 2601 | 19061 | 19080 | GGAGCTATTCAGGTCTCAAA | 20 | 57 |
| 1363589 | N/A | N/A | 13739 | 13758 | TGTTATTGCCACAAAATCCT | 40 | 523 |
| 1363610 | 2842 | 2861 | 19321 | 19340 | TTACAAAACATTTTCCCTCT | 53 | 524 |
| 1363611 | 2078 | 2097 | 18557 | 18576 | GATATGACAGAGGCCAGAGT | 30 | 525 |
| 1363631 | 1974 | 1993 | 18453 | 18472 | CATTAGCCACCAGCAACTGC | 50 | 526 |
| 1363711 | N/A | N/A | 6368 | 6387 | GCCACACTTTTTGCCTGGGC | 27 | 527 |
| 1363746 | 1435 | 1454 | 17914 | 17933 | TGAGAAGAAATTACTTTCTG | 101 | 528 |
| 1363825 | 2622 | 2641 | 19101 | 19120 | TAACCCAAAGTTAACAAAAA | 74 | 529 |
| 1363829 | 2235 | 2254 | 18714 | 18733 | AAAGAATTATTCTCCAGACA | 37 | 530 |
| 1363888 | 2406 | 2425 | 18885 | 18904 | TTAGCTAGAAAGAACGATCA | 29 | 531 |
| 1363891 | 2298 | 2317 | 18777 | 18796 | ATTTTTAATATCATTTGTGA | 78 | 532 |
| 1363897 | 2157 | 2176 | 18636 | 18655 | TTCTAAAACAAATCAAGACC | 55 | 533 |
| 1363899 | 2487 | 2506 | 18966 | 18985 | TATATCAGGAGAAAATAACC | 63 | 534 |
| 1363968 | N/A | N/A | 8085 | 8104 | GAGACCAATTGTACCCTGCA | 59 | 535 |
| 1363969 | 2260 | 2279 | 18739 | 18758 | CCTAGTTTAAAAAACAGTCA | 38 | 536 |
| 1363980 | 1401 | 1420 | 17880 | 17899 | CTTGAAAATTCAATTAGAGC | 62 | 537 |
| 1363983 | 1730 | 1749 | 18209 | 18228 | CTTCAGTAGTCCATCGCCAT | 21 | 538 |
| 1364000 | N/A | N/A | 12823 | 12842 | CTGAAGAGTTCTCTATCTCC | 59 | 539 |
| 1364002 | 3118 | 3137 | 19597 | 19616 | GATTGAGAACATTCTTAATT | 57 | 540 |
| 1364015 | 2749 | 2768 | 19228 | 19247 | GCTCTTACATCTCCTTAAAT | 28 | 541 |
| 1364024 | 2133 | 2152 | 18612 | 18631 | AATCACCTACGATGACTGAA | 33 | 542 |
| 1364047 | N/A | N/A | 8993 | 9012 | CTTTGATTTTTCACAGTCCA | 43 | 543 |
| 1364052 | 1360 | 1379 | 17839 | 17858 | AGTTGGGAAGTCATCTTCTT | 53 | 544 |
| 1364066 | 2670 | 2689 | 19149 | 19168 | AGTACAAATCTTTCCTTCAA | 16 | 545 |
| 1364084 | N/A | N/A | 17150 | 17169 | TAGACACACAGCCACATCAT | 67 | 546 |
| 1364089 | N/A | N/A | 8640 | 8659 | TACAAGAATTAAGCACACTA | 77 | 547 |
| 1364093 | 2051 | 2070 | 18530 | 18549 | TAATTAACAGAAAAAAAGAC | 103 | 548 |
| 1364155 | 2323 | 2342 | 18802 | 18821 | AAATCCCAATAGATTCAACT | 44 | 549 |
| 1364158 | 1252 | 1271 | 17731 | 17750 | AATCACTGCAAGACTCTCCT | 36 | 550 |
| 1364162 | 1590 | 1609 | 18069 | 18088 | TCTTCAGTGGTAATAGAGAG | 43 | 551 |
| 1364178 | 2197 | 2216 | 18676 | 18695 | ATAAGTAATAAACAAACTGG | 79 | 552 |
| 1364181 | 2348 | 2367 | 18827 | 18846 | TCTGCAAAGGCAGAATACTT | 73 | 553 |
| 1364189 | 2532 | 2551 | 19011 | 19030 | TTACCAACTGAATAGCTGAT | 32 | 554 |

TABLE 7-continued

Reduction of PLP1 RNA by 5-10-5 MOE gapmers with mixed PO/PS internucleoside linkages in SK-MEL-28 cells

| Compound ID | SEQ ID NO: 1 Start Site | SEQ ID NO: 1 Stop Site | SEQ ID NO: 2 Start Site | SEQ ID NO: 2 Stop Site | Sequence (5' to 3') | PLP1 (% UTC) | SEQ ID No. |
|---|---|---|---|---|---|---|---|
| 1364248 | 2989 | 3008 | 19468 | 19487 | CAGTTGATTAACTCTCTTTG | 21 | 555 |
| 1364262 | 2696 | 2715 | 19175 | 19194 | ACAACTCTTTACAACAAAAG | 49 | 556 |

TABLE 8

Reduction of PLP1 RNA by 5-10-5 MOE gapmers with mixed PO/PS internucleoside linkages in SK-MEL-28 cells

| Compound ID | SEQ ID NO: 1 Start Site | SEQ ID NO: 1 Stop Site | SEQ ID NO: 2 Start Site | SEQ ID NO: 2 Stop Site | Sequence (5' to 3') | PLP1 (% UTC) | SEQ ID No. |
|---|---|---|---|---|---|---|---|
| 1362437 | 2156 | 2175 | 18635 | 18654 | TCTAAAACAAATCAAGACCT | 45 | 557 |
| 1362490 | 1731 | 1750 | 18210 | 18229 | GCTTCAGTAGTCCATCGCCA | 13 | 201 |
| 1362518 | 2621 | 2640 | 19100 | 19119 | AACCCAAAGTTAACAAAAAC | 62 | 558 |
| 1362534 | 1470 | 1489 | 17949 | 17968 | CCTTCCACTTTGTTTCCATC | 64 | 559 |
| 1362548 | 2790 | 2809 | 19269 | 19288 | TATACTGGTTTGAAAACAAG | 55 | 560 |
| 1362580 | 1912 | 1931 | 18391 | 18410 | CTATTCTCAGCTCCTTGGAA | 36 | 561 |
| 1362584 | 1729 | 1748 | 18208 | 18227 | TTCAGTAGTCCATCGCCATC | 36 | 562 |
| 1362597 | 2378 | 2397 | 18857 | 18876 | AAATTGAGATTCAAATTCAC | 59 | 563 |
| 1362632 | 2004 | 2023 | 18483 | 18502 | TGTCTACCAGAGGGCCATCT | 25 | 564 |
| 1362664 | 2347 | 2366 | 18826 | 18845 | CTGCAAAGGCAGAATACTTG | 38 | 565 |
| 1362691 | 2322 | 2341 | 18801 | 18820 | AATCCCAATAGATTCAACTA | 45 | 566 |
| 1362735 | 2531 | 2550 | 19010 | 19029 | TACCAACTGAATAGCTGATG | 32 | 567 |
| 1362748 | N/A | N/A | 7382 | 7401 | TGTGCAAGCATTGGGAAGCT | 36 | 568 |
| 1362791 | N/A | N/A | 9728 | 9747 | GGGTAAGAAGAGCCATCCAC | 68 | 569 |
| 1362826 | N/A | N/A | 17523 | 17542 | CAATCATGAAGGTGAGCTGT | 72 | 570 |
| 1362849 | N/A | N/A | 6986 | 7005 | GCTCCATTCACCTACCATGG | 38 | 571 |
| 1362860 | 2405 | 2424 | 18884 | 18903 | TAGCTAGAAAGAACGATCAG | 51 | 572 |
| 1362900 | 2104 | 2123 | 18583 | 18602 | CCCCATGAAATGAGCACCAT | 19 | 573 |
| 1362913 | 2259 | 2278 | 18738 | 18757 | CTAGTTTAAAAAACAGTCAT | 41 | 574 |
| 1362961 | 1295 | 1314 | 17774 | 17793 | CTAAAAGAGGTACATAAGAG | 76 | 575 |
| 1362962 | 1973 | 1992 | 18452 | 18471 | ATTAGCCACCAGCAACTGCT | 39 | 576 |
| 1362965 | 1589 | 1608 | 18068 | 18087 | CTTCAGTGGTAATAGAGAGA | 32 | 577 |
| 1363027 | N/A | N/A | 11067 | 11086 | GCCAAGTAGATGACTGACTA | 33 | 578 |
| 1363036 | 1776 | 1795 | 18255 | 18274 | GATTCTACGCTCCCTTATGC | 54 | 579 |
| 1363069 | 1840 | 1859 | 18319 | 18338 | CTGACAACACCCTGTTTCTC | 32 | 580 |
| 1363077 | N/A | N/A | 11656 | 11675 | TTGTCAGACAGGATTTAGC | 45 | 581 |

TABLE 8-continued

Reduction of PLP1 RNA by 5-10-5 MOE gapmers with mixed PO/PS internucleoside linkages in SK-MEL-28 cells

| Compound ID | SEQ ID NO: 1 Start Site | SEQ ID NO: 1 Stop Site | SEQ ID NO: 2 Start Site | SEQ ID NO: 2 Stop Site | Sequence (5' to 3') | PLP1 (% UTC) | SEQ ID No. |
|---|---|---|---|---|---|---|---|
| 1363082 | N/A | N/A | 4537 | 4556 | TGTTTCCCATGGTCAAGCCA | 51 | 582 |
| 1363091 | N/A | N/A | 8053 | 8072 | TGTCCCTTGAATCCAGCTGA | 67 | 583 |
| 1363121 | 1732 | 1751 | 18211 | 18230 | GGCTTCAGTAGTCCATCGCC | 12 | 279 |
| 1363123 | 2132 | 2151 | 18611 | 18630 | ATCACCTACGATGACTGAAT | 36 | 584 |
| 1363126 | 3117 | 3136 | 19596 | 19615 | ATTGAGAACATTCTTAATTT | 75 | 585 |
| 1363141 | 2581 | 2600 | 19060 | 19079 | GAGCTATTCAGGTCTCAAAC | 21 | 586 |
| 1363200 | 2432 | 2451 | 18911 | 18930 | ACATTGCTAAGTAAAATCAT | 50 | 587 |
| 1363257 | 1081 | 1100 | 17560 | 17579 | CCCATGAGTTTAAGGACGGC | 22 | 588 |
| 1363295 | 2045 | 2064 | 18524 | 18543 | ACAGAAAAAAAGACATGCTA | 63 | 589 |
| 1363323 | 2486 | 2505 | 18965 | 18984 | ATATCAGGAGAAAATAACCT | 49 | 590 |
| 1363333 | 1400 | 1419 | 17879 | 17898 | TTGAAAATTCAATTAGAGCC | 47 | 591 |
| 1363340 | N/A | N/A | 6184 | 6203 | GCAGAGAATAATCAGCTACT | 62 | 592 |
| 1363367 | 1517 | 1536 | 17996 | 18015 | ATGGCAAGAGGACCAAAGAC | 65 | 593 |
| 1363436 | N/A | N/A | 8990 | 9009 | TGATTTTTCACAGTCCAAGA | 55 | 594 |
| 1363441 | 2297 | 2316 | 18776 | 18795 | TTTTTAATATCATTTGTGAT | 84 | 595 |
| 1363454 | N/A | N/A | 5435 | 5454 | CTGATGTTACCCAGGGCAGG | 44 | 596 |
| 1363455 | N/A | N/A | 14282 | 14301 | GGATCTTTAACTCCAGAGAC | 26 | 597 |
| 1363491 | N/A | N/A | 5817 | 5836 | CACTCCACATCAGAAGTAGT | 65 | 598 |
| 1363493 | 1550 | 1569 | 18029 | 18048 | GTACACCAAAGAGAATATAT | 18 | 599 |
| 1363504 | N/A | N/A | 5111 | 5130 | AGTTCATAAGTAGCAGATCT | 32 | 600 |
| 1363506 | 2987 | 3006 | 19466 | 19485 | GTTGATTAACTCTCTTTGTG | 33 | 601 |
| 1363565 | N/A | N/A | 13734 | 13753 | TTGCCACAAAATCCTGAGGA | 21 | 602 |
| 1363568 | 2234 | 2253 | 18713 | 18732 | AAGAATTATTCTCCAGACAT | 26 | 603 |
| 1363592 | 2077 | 2096 | 18556 | 18575 | ATATGACAGAGGCCAGAGTA | 38 | 604 |
| 1363623 | 3055 | 3074 | 19534 | 19553 | TCTAAAAGTTTATCCTTTAT | 37 | 605 |
| 1363644 | 1872 | 1891 | 18351 | 18370 | GCTGTTATCAAGGAGAAGGG | 23 | 606 |
| 1363650 | 2459 | 2478 | 18938 | 18957 | AAACCTAACTCTTAACACAC | 45 | 607 |
| 1363688 | N/A | N/A | 16190 | 16209 | AACTAAGTTTTCACTTCCCT | 72 | 608 |
| 1363704 | 1321 | 1340 | 17800 | 17819 | CAGGAACCAGCTATGAAGCA | 37 | 609 |
| 1363776 | 2194 | 2213 | 18673 | 18692 | AGTAATAAACAAACTGGAAT | 68 | 610 |
| 1363783 | 1359 | 1378 | 17838 | 17857 | GTTGGGAAGTCATCTTCTTA | 45 | 611 |
| 1363800 | 2891 | 2910 | 19370 | 19389 | AAAACACAAGGTACGGATTA | 38 | 612 |
| 1363852 | N/A | N/A | 10586 | 10605 | AAATTATCTCTGTCATGGGA | 55 | 613 |
| 1363865 | 3019 | 3038 | 19498 | 19517 | ATTCTATATCAGAAATGAAG | 64 | 614 |
| 1363879 | 2841 | 2860 | 19320 | 19339 | TACAAAACATTTTCCCTCTC | 59 | 615 |
| 1363901 | N/A | N/A | 16498 | 16517 | AGAAGCTTCCCTCCAGCATT | 84 | 616 |

TABLE 8-continued

Reduction of PLP1 RNA by 5-10-5 MOE gapmers with mixed PO/PS internucleoside linkages in SK-MEL-28 cells

| Compound ID | SEQ ID NO: 1 Start Site | SEQ ID NO: 1 Stop Site | SEQ ID NO: 2 Start Site | SEQ ID NO: 2 Stop Site | Sequence (5' to 3') | PLP1 (% UTC) | SEQ ID No. |
|---|---|---|---|---|---|---|---|
| 1363953 | 1214 | 1233 | 17693 | 17712 | AGTAAGAAGAGGGCCAGTTG | 75 | 617 |
| 1363956 | N/A | N/A | 15143 | 15162 | CCACCACTTCCAAGTTCCCT | 69 | 618 |
| 1363972 | N/A | N/A | 6367 | 6386 | CCACACTTTTTGCCTGGGCT | 25 | 619 |
| 1363993 | 1655 | 1674 | 18134 | 18153 | CCAGCTGCAATAGGCAGATT | 21 | 620 |
| 1364008 | 2668 | 2687 | 19147 | 19166 | TACAAATCTTTCCTTCAATT | 43 | 621 |
| 1364009 | N/A | N/A | 8638 | 8657 | CAAGAATTAAGCACACTAGC | 77 | 622 |
| 1364035 | 1434 | 1453 | 17913 | 17932 | GAGAAGAAATTACTTTCTGA | 113 | 623 |
| 1364039 | 1182 | 1201 | 17661 | 17680 | AAGAGTTAAGATGGGAGACG | 66 | 624 |
| 1364042 | N/A | N/A | 17149 | 17168 | AGACACACAGCCACATCATG | 57 | 625 |
| 1364065 | N/A | N/A | 11896 | 11915 | TCATCAACTATTTATGGAAT | 67 | 626 |
| 1364073 | N/A | N/A | 9220 | 9239 | CAGTAATATCAGCATAAGCA | 23 | 627 |
| 1364112 | N/A | N/A | 12817 | 12836 | AGTTCTCTATCTCCAGGATG | 56 | 628 |
| 1364128 | 1250 | 1269 | 17729 | 17748 | TCACTGCAAGACTCTCCTTT | 45 | 629 |
| 1364159 | 2695 | 2714 | 19174 | 19193 | CAACTCTTTACAACAAAAGA | 75 | 630 |
| 1364171 | 2748 | 2767 | 19227 | 19246 | CTCTTACATCTCCTTAAATA | 43 | 631 |
| 1364185 | N/A | N/A | 16858 | 16877 | ATAATGTTAGGAGGTCCTCC | 33 | 632 |
| 1364187 | N/A | N/A | 15658 | 15677 | TCTATGCTCATTGGCTCAGG | 70 | 633 |

TABLE 9

Reduction of PLP1 RNA by 5-10-5 MOE gapmers with mixed PO/PS internucleoside linkages in SK-MEL-28 cells

| Compound ID | SEQ ID NO: 1 Start Site | SEQ ID NO: 1 Stop Site | SEQ ID NO: 2 Start Site | SEQ ID NO: 2 Stop Site | Sequence (5' to 3') | PLP1 (% UTC) | SEQ ID No. |
|---|---|---|---|---|---|---|---|
| 1362479 | 3115 | 3134 | 19594 | 19613 | TGAGAACATTCTTAATTTTA | 84 | 634 |
| 1362490 | 1731 | 1750 | 18210 | 18229 | GCTTCAGTAGTCCATCGCCA | 14 | 201 |
| 1362499 | 1469 | 1488 | 17948 | 17967 | CTTCCACTTTGTTTCCATCA | 70 | 635 |
| 1362545 | N/A | N/A | 11653 | 11672 | TCAGACAGGATTTTAGCATG | 65 | 636 |
| 1362561 | N/A | N/A | 16189 | 16208 | ACTAAGTTTTCACTTCCCTA | 72 | 637 |
| 1362586 | N/A | N/A | 6181 | 6200 | GAGAATAATCAGCTACTGCT | 76 | 638 |
| 1362634 | N/A | N/A | 7948 | 7967 | GTCTCGAATCTGCACTACAG | 57 | 639 |
| 1362635 | 1516 | 1535 | 17995 | 18014 | TGGCAAGAGGACCAAAGACA | 62 | 640 |
| 1362638 | 2985 | 3004 | 19464 | 19483 | TGATTAACTCTCTTTGTGTG | 49 | 641 |
| 1362669 | 2840 | 2859 | 19319 | 19338 | ACAAAACATTTTCCCTCTCC | 57 | 642 |
| 1362681 | 1294 | 1313 | 17773 | 17792 | TAAAAGAGGTACATAAGAGG | 84 | 643 |
| 1362695 | 2155 | 2174 | 18634 | 18653 | CTAAAACAAATCAAGACCTT | 62 | 644 |

TABLE 9-continued

Reduction of PLP1 RNA by 5-10-5 MOE gapmers with mixed PO/PS internucleoside linkages in SK-MEL-28 cells

| Compound ID | SEQ ID NO: 1 Start Site | SEQ ID NO: 1 Stop Site | SEQ ID NO: 2 Start Site | SEQ ID NO: 2 Stop Site | Sequence (5' to 3') | PLP1 (% UTC) | SEQ ID No. |
|---|---|---|---|---|---|---|---|
| 1362737 | 2746 | 2765 | 19225 | 19244 | CTTACATCTCCTTAAATATT | 38 | 645 |
| 1362769 | 1654 | 1673 | 18133 | 18152 | CAGCTGCAATAGGCAGATTT | 41 | 646 |
| 1362802 | N/A | N/A | 10560 | 10579 | AGGTAGAGGCATTTGCCTCT | 85 | 647 |
| 1362852 | N/A | N/A | 17360 | 17379 | GCTTGGCTTTCTCCATATAC | 34 | 648 |
| 1362863 | 2377 | 2396 | 18856 | 18875 | AATTGAGATTCAAATTCACC | 46 | 649 |
| 1362872 | N/A | N/A | 7378 | 7397 | CAAGCATTGGGAAGCTGAGG | 42 | 650 |
| 1362893 | N/A | N/A | 5108 | 5127 | TCATAAGTAGCAGATCTGGG | 44 | 651 |
| 1362939 | 2346 | 2365 | 18825 | 18844 | TGCAAAGGCAGAATACTTGT | 60 | 652 |
| 1362942 | 1399 | 1418 | 17878 | 17897 | TGAAAATTCAATTAGAGCCT | 43 | 653 |
| 1362943 | 2044 | 2063 | 18523 | 18542 | CAGAAAAAAAGACATGCTAT | 78 | 654 |
| 1363003 | 1181 | 1200 | 17660 | 17679 | AGAGTTAAGATGGGAGACGC | 52 | 655 |
| 1363075 | N/A | N/A | 15624 | 15643 | ATGTTGTAGAAGGCAATCGG | 59 | 656 |
| 1363093 | 2296 | 2315 | 18775 | 18794 | TTTTAATATCATTTGTGATG | 73 | 657 |
| 1363121 | 1732 | 1751 | 18211 | 18230 | GGCTTCAGTAGTCCATCGCC | 15 | 279 |
| 1363146 | 2076 | 2095 | 18555 | 18574 | TATGACAGAGGCCAGAGTAC | 22 | 658 |
| 1363166 | 1871 | 1890 | 18350 | 18369 | CTGTTATCAAGGAGAAGGGA | 24 | 659 |
| 1363178 | N/A | N/A | 15110 | 15129 | ACCTCTCTGGTTTCAGTAGG | 67 | 660 |
| 1363185 | 2485 | 2504 | 18964 | 18983 | TATCAGGAGAAAATAACCTT | 44 | 661 |
| 1363201 | 1249 | 1268 | 17728 | 17747 | CACTGCAAGACTCTCCTTTC | 34 | 662 |
| 1363251 | 2103 | 2122 | 18582 | 18601 | CCCATGAAATGAGCACCATT | 43 | 663 |
| 1363285 | N/A | N/A | 17148 | 17167 | GACACACAGCCACATCATGC | 57 | 664 |
| 1363314 | 1728 | 1747 | 18207 | 18226 | TCAGTAGTCCATCGCCATCG | 23 | 123 |
| 1363328 | 2002 | 2021 | 18481 | 18500 | TCTACCAGAGGGCCATCTCA | 50 | 665 |
| 1363346 | 2580 | 2599 | 19059 | 19078 | AGCTATTCAGGTCTCAAACT | 39 | 666 |
| 1363347 | 2404 | 2423 | 18883 | 18902 | AGCTAGAAAGAACGATCAGA | 38 | 667 |
| 1363364 | N/A | N/A | 4532 | 4551 | CCCATGGTCAAGCCATTGAG | 63 | 668 |
| 1363380 | N/A | N/A | 14246 | 14265 | CCTCACTCAAAGCATGGATA | 26 | 669 |
| 1363406 | N/A | N/A | 9219 | 9238 | AGTAATATCAGCATAAGCAT | 46 | 670 |
| 1363419 | 2890 | 2909 | 19369 | 19388 | AAACACAAGGTACGGATTAC | 40 | 671 |
| 1363448 | 2620 | 2639 | 19099 | 19118 | ACCCAAAGTTAACAAAAACA | 52 | 672 |
| 1363462 | N/A | N/A | 5421 | 5440 | GGCAGGAATTGAGTTCCTCC | 35 | 673 |
| 1363480 | N/A | N/A | 11894 | 11913 | ATCAACTATTTATGGAATAC | 62 | 674 |
| 1363507 | 2193 | 2212 | 18672 | 18691 | GTAATAAACAAACTGGAATA | 88 | 675 |
| 1363527 | N/A | N/A | 8637 | 8656 | AAGAATTAAGCACACTAGCA | 80 | 676 |
| 1363551 | 2233 | 2252 | 18712 | 18731 | AGAATTATTCTCCAGACATT | 35 | 677 |
| 1363604 | 3054 | 3073 | 19533 | 19552 | CTAAAAGTTTATCCTTTATG | 60 | 678 |

TABLE 9-continued

| Reduction of PLP1 RNA by 5-10-5 MOE gapmers with mixed PO/PS internucleoside linkages in SK-MEL-28 cells | | | | | | | |
|---|---|---|---|---|---|---|---|
| Compound ID | SEQ ID NO: 1 Start Site | SEQ ID NO: 1 Stop Site | SEQ ID NO: 2 Start Site | SEQ ID NO: 2 Stop Site | Sequence (5' to 3') | PLP1 (% UTC) | SEQ ID No. |
| 1363608 | 1213 | 1232 | 17692 | 17711 | GTAAGAAGAGGGCCAGTTGG | 80 | 679 |
| 1363613 | 1433 | 1452 | 17912 | 17931 | AGAAGAAATTACTTTCTGAT | 115 | 680 |
| 1363636 | N/A | N/A | 6979 | 6998 | TCACCTACCATGGCTGCTGT | 66 | 681 |
| 1363654 | 2667 | 2686 | 19146 | 19165 | ACAAATCTTTCCTTCAATTA | 59 | 682 |
| 1363656 | 2321 | 2340 | 18800 | 18819 | ATCCCAATAGATTCAACTAG | 35 | 683 |
| 1363676 | 2258 | 2277 | 18737 | 18756 | TAGTTTAAAAAACAGTCATA | 94 | 684 |
| 1363686 | 2530 | 2549 | 19009 | 19028 | ACCAACTGAATAGCTGATGA | 27 | 685 |
| 1363706 | 342 | 361 | 12634 | 12653 | AACACAATCCAGTGGCCACC | 67 | 686 |
| 1363721 | 2131 | 2150 | 18610 | 18629 | TCACCTACGATGACTGAATG | 56 | 687 |
| 1363732 | N/A | N/A | 8983 | 9002 | TCACAGTCCAAGAAATGTCC | 62 | 688 |
| 1363742 | N/A | N/A | 9634 | 9653 | GGTATGGTCAGGGATGGAGG | 55 | 689 |
| 1363756 | 1079 | 1098 | 17558 | 17577 | CATGAGTTTAAGGACGGCAA | 36 | 690 |
| 1363758 | N/A | N/A | 13732 | 13751 | GCCACAAAATCCTGAGGATG | 14 | 691 |
| 1363814 | 1320 | 1339 | 17799 | 17818 | AGGAACCAGCTATGAAGCAA | 26 | 692 |
| 1363856 | 1839 | 1858 | 18318 | 18337 | TGACAACACCCTGTTTCTCT | 24 | 693 |
| 1363876 | N/A | N/A | 6330 | 6349 | GCCAGCCAAAACTACACTGC | 53 | 694 |
| 1363991 | 2431 | 2450 | 18910 | 18929 | CATTGCTAAGTAAAATCATT | 47 | 695 |
| 1364012 | 1588 | 1607 | 18067 | 18086 | TTCAGTGGTAATAGAGAGAC | 64 | 696 |
| 1364018 | 2458 | 2477 | 18937 | 18956 | AACCTAACTCTTAACACACC | 34 | 697 |
| 1364028 | 1972 | 1991 | 18451 | 18470 | TTAGCCACCAGCAACTGCTG | 43 | 698 |
| 1364071 | 1911 | 1930 | 18390 | 18409 | TATTCTCAGCTCCTTGGAAA | 72 | 699 |
| 1364081 | 1358 | 1377 | 17837 | 17856 | TTGGGAAGTCATCTTCTTAG | 61 | 700 |
| 1364139 | 2693 | 2712 | 19172 | 19191 | ACTCTTTACAACAAAAGAAC | 48 | 701 |
| 1364163 | N/A | N/A | 16489 | 16508 | CCTCCAGCATTTCAAGGATG | 79 | 702 |
| 1364196 | 3018 | 3037 | 19497 | 19516 | TTCTATATCAGAAATGAAGG | 49 | 703 |
| 1364213 | N/A | N/A | 10960 | 10979 | TGTCTTAATTCATATGTATG | 61 | 704 |
| 1364246 | 1770 | 1789 | 18249 | 18268 | ACGCTCCCTTATGCTGTAAG | 13 | 49 |
| 1364249 | N/A | N/A | 16791 | 16810 | GGATTCATATTGATAGTATA | 76 | 705 |
| 1364260 | 1549 | 1568 | 18028 | 18047 | TACACCAAAGAGAATATATT | 79 | 706 |
| 1364263 | N/A | N/A | 5816 | 5835 | ACTCCACATCAGAAGTAGTG | 53 | 707 |
| 1364272 | 2789 | 2808 | 19268 | 19287 | ATACTGGTTTGAAAACAAGT | 35 | 708 |

TABLE 10

Reduction of PLP1 RNA by 5-10-5 MOE gapmers with mixed PO/PS internucleoside linkages in SK-MEL-28 cells

| Compound ID | SEQ ID NO: 1 Start Site | SEQ ID NO: 1 Stop Site | SEQ ID NO: 2 Start Site | SEQ ID NO: 2 Stop Site | Sequence (5' to 3') | PLP1 (% UTC) | SEQ ID No. |
|---|---|---|---|---|---|---|---|
| 1362447 | 1652 | 1671 | 18131 | 18150 | GCTGCAATAGGCAGATTTGG | 29 | 709 |
| 1362477 | N/A | N/A | 5416 | 5435 | GAATTGAGTTCCTCCAACAT | 73 | 710 |
| 1362490 | 1731 | 1750 | 18210 | 18229 | GCTTCAGTAGTCCATCGCCA | 16 | 201 |
| 1362491 | N/A | N/A | 6303 | 6322 | ACAGCCACTTTTGGATGGAG | 55 | 711 |
| 1362533 | 2129 | 2148 | 18608 | 18627 | ACCTACGATGACTGAATGGA | 49 | 712 |
| 1362559 | 2376 | 2395 | 18855 | 18874 | ATTGAGATTCAAATTCACCA | 18 | 713 |
| 1362565 | 2578 | 2597 | 19057 | 19076 | CTATTCAGGTCTCAAACTCT | 30 | 714 |
| 1362569 | N/A | N/A | 15623 | 15642 | TGTTGTAGAAGGCAATCGGC | 75 | 715 |
| 1362588 | N/A | N/A | 16065 | 16084 | GGTTCCCTACAGTTGTGCCC | 37 | 716 |
| 1362599 | 1355 | 1374 | 17834 | 17853 | GGAAGTCATCTTCTTAGGCA | 44 | 717 |
| 1362612 | 2320 | 2339 | 18799 | 18818 | TCCCAATAGATTCAACTAGC | 22 | 718 |
| 1362642 | 2666 | 2685 | 19145 | 19164 | CAAATCTTTCCTTCAATTAA | 72 | 719 |
| 1362649 | N/A | N/A | 16781 | 16800 | TGATAGTATATAGAATTCCA | 23 | 720 |
| 1362651 | N/A | N/A | 8627 | 8646 | CACACTAGCAGTGACATAGA | 75 | 721 |
| 1362665 | 3114 | 3133 | 19593 | 19612 | GAGAACATTCTTAATTTTAT | 68 | 722 |
| 1362707 | 2484 | 2503 | 18963 | 18982 | ATCAGGAGAAAATAACCTTT | 30 | 723 |
| 1362714 | 1838 | 1857 | 18317 | 18336 | GACAACACCCTGTTTCTCTT | 30 | 724 |
| 1362715 | 2430 | 2449 | 18909 | 18928 | ATTGCTAAGTAAAATCATTT | 50 | 725 |
| 1362744 | N/A | N/A | 7940 | 7959 | TCTGCACTACAGTCTTACCC | 67 | 726 |
| 1362747 | 2745 | 2764 | 19224 | 19243 | TTACATCTCCTTAAATATTG | 56 | 727 |
| 1362757 | 2619 | 2638 | 19098 | 19117 | CCCAAAGTTAACAAAAACAG | 36 | 728 |
| 1362761 | N/A | N/A | 4531 | 4550 | CCATGGTCAAGCCATTGAGG | 61 | 729 |
| 1362799 | 2889 | 2908 | 19368 | 19387 | AACACAAGGTACGGATTACT | 41 | 730 |
| 1362874 | 2042 | 2061 | 18521 | 18540 | GAAAAAAAGACATGCTATCC | 64 | 731 |
| 1362906 | 2102 | 2121 | 18581 | 18600 | CCATGAAATGAGCACCATTG | 26 | 732 |
| 1362924 | 1769 | 1788 | 18248 | 18267 | CGCTCCCTTATGCTGTAAGT | 21 | 282 |
| 1362985 | 3053 | 3072 | 19532 | 19551 | TAAAAGTTTATCCTTTATGT | 85 | 733 |
| 1363066 | N/A | N/A | 5814 | 5833 | TCCACATCAGAAGTAGTGGC | 59 | 734 |
| 1363074 | 1248 | 1267 | 17727 | 17746 | ACTGCAAGACTCTCCTTTCT | 38 | 735 |
| 1363108 | 1432 | 1451 | 17911 | 17930 | GAAGAAATTACTTTCTGATC | 111 | 736 |
| 1363113 | N/A | N/A | 10892 | 10911 | AAACACAGTATACACATGCA | 71 | 737 |
| 1363116 | 2403 | 2422 | 18882 | 18901 | GCTAGAAAGAACGATCAGAT | 39 | 738 |
| 1363121 | 1732 | 1751 | 18211 | 18230 | GGCTTCAGTAGTCCATCGCC | 21 | 279 |
| 1363169 | 1870 | 1889 | 18349 | 18368 | TGTTATCAAGGAGAAGGGAG | 43 | 739 |
| 1363197 | N/A | N/A | 6179 | 6198 | GAATAATCAGCTACTGCTCT | 89 | 740 |
| 1363207 | N/A | N/A | 11650 | 11669 | GACAGGATTTAGCATGAAG | 66 | 741 |

TABLE 10-continued

Reduction of PLP1 RNA by 5-10-5 MOE gapmers with mixed PO/PS internucleoside linkages in SK-MEL-28 cells

| Compound ID | SEQ ID NO: 1 Start Site | SEQ ID NO: 1 Stop Site | SEQ ID NO: 2 Start Site | SEQ ID NO: 2 Stop Site | Sequence (5' to 3') | PLP1 (% UTC) | SEQ ID No. |
|---|---|---|---|---|---|---|---|
| 1363213 | 1398 | 1417 | 17877 | 17896 | GAAAATTCAATTAGAGCCTC | 43 | 742 |
| 1363270 | N/A | N/A | 6925 | 6944 | TCTTCTTTAGACCTGAAGTG | 74 | 743 |
| 1363280 | 1909 | 1928 | 18388 | 18407 | TTCTCAGCTCCTTGGAAACC | 52 | 744 |
| 1363303 | 1179 | 1198 | 17658 | 17677 | AGTTAAGATGGGAGACGCAG | 47 | 745 |
| 1363326 | 1467 | 1486 | 17946 | 17965 | TCCACTTTGTTTCCATCAGT | 72 | 746 |
| 1363438 | 2956 | 2975 | 19435 | 19454 | GTGTATGTATGCATGTGAGG | 29 | 747 |
| 1363440 | 1293 | 1312 | 17772 | 17791 | AAAAGAGGTACATAAGAGGG | 68 | 748 |
| 1363449 | N/A | N/A | 5046 | 5065 | TCCTGTTTTACCTGAACACA | 66 | 749 |
| 1363473 | 2192 | 2211 | 18671 | 18690 | TAATAAACAAACTGGAATAC | 90 | 750 |
| 1363482 | N/A | N/A | 16486 | 16505 | CCAGCATTTCAAGGATGGAA | 55 | 751 |
| 1363488 | N/A | N/A | 15073 | 15092 | AGACCCAATCATTCATCATC | 70 | 752 |
| 1363496 | 1708 | 1727 | 18187 | 18206 | GGGTCAGTGCTCTCTTTCTG | 37 | 753 |
| 1363509 | 1211 | 1230 | 17690 | 17709 | AAGAAGAGGGCCAGTTGGTG | 77 | 754 |
| 1363525 | 2692 | 2711 | 19171 | 19190 | CTCTTTACAACAAAAGAACT | 78 | 755 |
| 1363543 | 2528 | 2547 | 19007 | 19026 | CAACTGAATAGCTGATGACT | 58 | 756 |
| 1363556 | N/A | N/A | 9617 | 9636 | AGGAACTTGAACTCTTGCTA | 47 | 757 |
| 1363569 | 2075 | 2094 | 18554 | 18573 | ATGACAGAGGCCAGAGTACA | 44 | 758 |
| 1363605 | 1587 | 1606 | 18066 | 18085 | TCAGTGGTAATAGAGAGACC | 54 | 759 |
| 1363620 | 2257 | 2276 | 18736 | 18755 | AGTTTAAAAAACAGTCATAA | 96 | 760 |
| 1363639 | 2295 | 2314 | 18774 | 18793 | TTTAATATCATTTGTGATGC | 30 | 761 |
| 1363661 | 3017 | 3036 | 19496 | 19515 | TCTATATCAGAAATGAAGGA | 47 | 762 |
| 1363677 | N/A | N/A | 17147 | 17166 | ACACACAGCCACATCATGCA | 61 | 763 |
| 1363709 | 2001 | 2020 | 18480 | 18499 | CTACCAGAGGGCCATCTCAG | 51 | 764 |
| 1363754 | 2788 | 2807 | 19267 | 19286 | TACTGGTTTGAAAACAAGTA | 38 | 765 |
| 1363771 | 2154 | 2173 | 18633 | 18652 | TAAAACAAATCAAGACCTTC | 55 | 766 |
| 1363781 | N/A | N/A | 11893 | 11912 | TCAACTATTTATGGAATACT | 69 | 767 |
| 1363799 | 1078 | 1097 | 17557 | 17576 | ATGAGTTTAAGGACGGCAAA | 55 | 768 |
| 1363810 | 1515 | 1534 | 17994 | 18013 | GGCAAGAGGACCAAAGACAT | 40 | 769 |
| 1363864 | N/A | N/A | 8958 | 8977 | GTATGTGTGAACAATAGCCT | 56 | 770 |
| 1363895 | N/A | N/A | 14243 | 14262 | CACTCAAAGCATGGATAACC | 54 | 771 |
| 1363931 | 2838 | 2857 | 19317 | 19336 | AAAACATTTTCCCTCTCCTC | 58 | 772 |
| 1363950 | 340 | 359 | 12632 | 12651 | CACAATCCAGTGGCCACCAG | 72 | 773 |
| 1363997 | 2232 | 2251 | 18711 | 18730 | GAATTATTCTCCAGACATTT | 42 | 774 |
| 1363999 | 1319 | 1338 | 17798 | 17817 | GGAACCAGCTATGAAGCAAA | 32 | 775 |
| 1364010 | 2345 | 2364 | 18824 | 18843 | GCAAAGGCAGAATACTTGTA | 50 | 776 |
| 1364104 | 2457 | 2476 | 18936 | 18955 | ACCTAACTCTTAACACACCA | 32 | 777 |

TABLE 10-continued

Reduction of PLP1 RNA by 5-10-5 MOE gapmers with mixed PO/PS internucleoside linkages in SK-MEL-28 cells

| Compound ID | SEQ ID NO: 1 Start Site | SEQ ID NO: 1 Stop Site | SEQ ID NO: 2 Start Site | SEQ ID NO: 2 Stop Site | Sequence (5' to 3') | PLP1 (% UTC) | SEQ ID No. |
|---|---|---|---|---|---|---|---|
| 1364114 | N/A | N/A | 17351 | 17370 | TCTCCATATACACTTGACTG | 46 | 778 |
| 1364130 | N/A | N/A | 10367 | 10386 | GCTGCCAGGAAACTTGGCCT | 41 | 779 |
| 1364150 | N/A | N/A | 13731 | 13750 | CCACAAAATCCTGAGGATGA | 28 | 780 |
| 1364153 | N/A | N/A | 9218 | 9237 | GTAATATCAGCATAAGCATC | 57 | 781 |
| 1364169 | N/A | N/A | 7343 | 7362 | TAAAACTTATCCTTGGCACA | 93 | 782 |
| 1364252 | 1548 | 1567 | 18027 | 18046 | ACACCAAAGAGAATATATTT | 71 | 783 |
| 1364255 | 1971 | 1990 | 18450 | 18469 | TAGCCACCAGCAACTGCTGC | 31 | 784 |

TABLE 11

Reduction of PLP1 RNA by 5-10-5 MOE gapmers with mixed PO/PS internucleoside linkages in SK-MEL-28 cells

| Compound ID | SEQ ID NO: 1 Start Site | SEQ ID NO: 1 Stop Site | SEQ ID NO: 2 Start Site | SEQ ID NO: 2 Stop Site | Sequence (5' to 3') | PLP1 (% UTC) | SEQ ID No. |
|---|---|---|---|---|---|---|---|
| 1362445 | 2319 | 2338 | 18798 | 18817 | CCCAATAGATTCAACTAGCC | 24 | 134 |
| 1362482 | N/A | N/A | 16485 | 16504 | CAGCATTTCAAGGATGGAAG | 51 | 785 |
| 1362490 | 1731 | 1750 | 18210 | 18229 | GCTTCAGTAGTCCATCGCCA | 30 | 201 |
| 1362513 | 1869 | 1888 | 18348 | 18367 | GTTATCAAGGAGAAGGGAGT | 37 | 786 |
| 1362549 | N/A | N/A | 5045 | 5064 | CCTGTTTTACCTGAACACAT | 53 | 787 |
| 1362550 | 2041 | 2060 | 18520 | 18539 | AAAAAAAGACATGCTATCCA | 63 | 788 |
| 1362560 | 2455 | 2474 | 18934 | 18953 | CTAACTCTTAACACACCAAG | 49 | 789 |
| 1362564 | N/A | N/A | 9215 | 9234 | ATATCAGCATAAGCATCAGA | 73 | 790 |
| 1362603 | N/A | N/A | 7337 | 7356 | TTATCCTTGGCACATTGTCT | 74 | 791 |
| 1362617 | 2344 | 2363 | 18823 | 18842 | CAAAGGCAGAATACTTGTAG | 53 | 792 |
| 1362699 | 1768 | 1787 | 18247 | 18266 | GCTCCCTTATGCTGTAAGTA | 35 | 204 |
| 1362804 | 1318 | 1337 | 17797 | 17816 | GAACCAGCTATGAAGCAAAA | 40 | 793 |
| 1362835 | 2618 | 2637 | 19097 | 19116 | CCAAAGTTAACAAAAACAGG | 63 | 794 |
| 1362840 | 2256 | 2275 | 18735 | 18754 | GTTTAAAAAACAGTCATAAT | 97 | 795 |
| 1362844 | N/A | N/A | 10891 | 10910 | AACACAGTATACACATGCAC | 48 | 796 |
| 1362996 | 2483 | 2502 | 18962 | 18981 | TCAGGAGAAAATAACCTTTA | 28 | 797 |
| 1363019 | 2294 | 2313 | 18773 | 18792 | TTAATATCATTTGTGATGCT | 25 | 798 |
| 1363020 | 1466 | 1485 | 17945 | 17964 | CCACTTTGTTTCCATCAGTG | 64 | 799 |
| 1363023 | 2000 | 2019 | 18479 | 18498 | TACCAGAGGGCCATCTCAGG | 53 | 800 |
| 1363032 | 3016 | 3035 | 19495 | 19514 | CTATATCAGAAATGAAGGAA | 56 | 801 |
| 1363037 | 2189 | 2208 | 18668 | 18687 | TAAACAAACTGGAATACATG | 93 | 802 |
| 1363086 | 2787 | 2806 | 19266 | 19285 | ACTGGTTTGAAAACAAGTAT | 49 | 803 |

TABLE 11-continued

Reduction of PLP1 RNA by 5-10-5 MOE gapmers with mixed PO/PS internucleoside linkages in SK-MEL-28 cells

| Compound ID | SEQ ID NO: 1 Start Site | SEQ ID NO: 1 Stop Site | SEQ ID NO: 2 Start Site | SEQ ID NO: 2 Stop Site | Sequence (5' to 3') | PLP1 (% UTC) | SEQ ID No. |
|---|---|---|---|---|---|---|---|
| 1363090 | N/A | N/A | 17146 | 17165 | CACACAGCCACATCATGCAG | 89 | 804 |
| 1363095 | N/A | N/A | 4528 | 4547 | TGGTCAAGCCATTGAGGACT | 41 | 805 |
| 1363097 | N/A | N/A | 16064 | 16083 | GTTCCCTACAGTTGTGCCCA | 41 | 806 |
| 1363109 | 2375 | 2394 | 18854 | 18873 | TTGAGATTCAAATTCACCAA | 44 | 807 |
| 1363121 | 1732 | 1751 | 18211 | 18230 | GGCTTCAGTAGTCCATCGCC | 22 | 279 |
| 1363131 | N/A | N/A | 16780 | 16799 | GATAGTATATAGAATTCCAG | 40 | 808 |
| 1363135 | 304 | 323 | 12596 | 12615 | CCTACCAGACATCTTGCACA | 44 | 809 |
| 1363147 | 1547 | 1566 | 18026 | 18045 | CACCAAAGAGAATATATTTG | 58 | 810 |
| 1363148 | 1431 | 1450 | 17910 | 17929 | AAGAAATTACTTTCTGATCC | 79 | 811 |
| 1363160 | 2577 | 2596 | 19056 | 19075 | TATTCAGGTCTCAAACTCTT | 42 | 812 |
| 1363193 | 2074 | 2093 | 18553 | 18572 | TGACAGAGGCCAGAGTACAC | 43 | 813 |
| 1363217 | 1908 | 1927 | 18387 | 18406 | TCTCAGCTCCTTGGAAACCA | 38 | 814 |
| 1363250 | N/A | N/A | 11542 | 11561 | CTTCTTAGTTTACATATGGG | 40 | 815 |
| 1363256 | 3089 | 3108 | 19568 | 19587 | TTAATTTTATAAAATACACT | 99 | 816 |
| 1363271 | 2665 | 2684 | 19144 | 19163 | AAATCTTTCCTTCAATTAAA | 80 | 817 |
| 1363296 | N/A | N/A | 6302 | 6321 | CAGCCACTTTTGGATGGAGG | 54 | 818 |
| 1363343 | 1178 | 1197 | 17657 | 17676 | GTTAAGATGGGAGACGCAGC | 46 | 819 |
| 1363363 | 2402 | 2421 | 18881 | 18900 | CTAGAAAGAACGATCAGATT | 69 | 820 |
| 1363376 | N/A | N/A | 8952 | 8971 | GTGAACAATAGCCTAAAGCC | 59 | 821 |
| 1363386 | N/A | N/A | 15072 | 15091 | GACCCAATCATTCATCATCT | 60 | 822 |
| 1363427 | 1651 | 1670 | 18130 | 18149 | CTGCAATAGGCAGATTTGGG | 24 | 823 |
| 1363469 | 2230 | 2249 | 18709 | 18728 | ATTATTCTCCAGACATTTCT | 66 | 824 |
| 1363579 | N/A | N/A | 9615 | 9634 | GAACTTGAACTCTTGCTAGC | 69 | 825 |
| 1363583 | 1586 | 1605 | 18065 | 18084 | CAGTGGTAATAGAGAGACCA | 24 | 826 |
| 1363586 | 2153 | 2172 | 18632 | 18651 | AAAACAAATCAAGACCTTCA | 57 | 827 |
| 1363609 | 2100 | 2119 | 18579 | 18598 | ATGAAATGAGCACCATTGTG | 45 | 828 |
| 1363614 | N/A | N/A | 7936 | 7955 | CACTACAGTCTTACCCTCCT | 83 | 829 |
| 1363632 | 2837 | 2856 | 19316 | 19335 | AAACATTTTCCCTCTCCTCC | 57 | 830 |
| 1363652 | 2691 | 2710 | 19170 | 19189 | TCTTTACAACAAAAGAACTG | 73 | 831 |
| 1363660 | 3052 | 3071 | 19531 | 19550 | AAAAGTTTATCCTTTATGTG | 69 | 832 |
| 1363665 | 1275 | 1294 | 17754 | 17773 | GGGAGAGTCCAAAGAGAGAC | 77 | 833 |
| 1363668 | 1695 | 1714 | 18174 | 18193 | CTTTCTGTGGGTGAAAGATC | 70 | 834 |
| 1363715 | 1246 | 1265 | 17725 | 17744 | TGCAAGACTCTCCTTTCTTG | 51 | 835 |
| 1363727 | N/A | N/A | 8625 | 8644 | CACTAGCAGTGACATAGACA | 71 | 836 |
| 1363759 | 2888 | 2907 | 19367 | 19386 | ACACAAGGTACGGATTACTT | 42 | 59 |
| 1363775 | N/A | N/A | 5812 | 5831 | CACATCAGAAGTAGTGGCAG | 66 | 837 |

TABLE 11-continued

Reduction of PLP1 RNA by 5-10-5 MOE gapmers with mixed PO/PS internucleoside linkages in SK-MEL-28 cells

| Compound ID | SEQ ID NO: 1 Start Site | SEQ ID NO: 1 Stop Site | SEQ ID NO: 2 Start Site | SEQ ID NO: 2 Stop Site | Sequence (5' to 3') | PLP1 (% UTC) | SEQ ID No. |
|---|---|---|---|---|---|---|---|
| 1363805 | 2954 | 2973 | 19433 | 19452 | GTATGTATGCATGTGAGGTT | 60 | 838 |
| 1363811 | N/A | N/A | 17349 | 17368 | TCCATATACACTTGACTGGA | 50 | 839 |
| 1363872 | 1834 | 1853 | 18313 | 18332 | ACACCCTGTTTCTCTTCCCT | 39 | 840 |
| 1363917 | N/A | N/A | 15622 | 15641 | GTTGTAGAAGGCAATCGGCT | 63 | 841 |
| 1363933 | 1969 | 1988 | 18448 | 18467 | GCCACCAGCAACTGCTGCTC | 29 | 842 |
| 1363947 | N/A | N/A | 6003 | 6022 | TTCTATATGGTTGAAGTAGT | 61 | 843 |
| 1363957 | 2743 | 2762 | 19222 | 19241 | ACATCTCCTTAAATATTGCT | 33 | 844 |
| 1364023 | N/A | N/A | 5411 | 5430 | GAGTTCCTCCAACATTCACC | 39 | 845 |
| 1364038 | 1077 | 1096 | 17556 | 17575 | TGAGTTTAAGGACGGCAAAG | 80 | 846 |
| 1364060 | 1397 | 1416 | 17876 | 17895 | AAAATTCAATTAGAGCCTCC | 49 | 847 |
| 1364098 | 1210 | 1229 | 17689 | 17708 | AGAAGAGGGCCAGTTGGTGG | 69 | 848 |
| 1364106 | 1350 | 1369 | 17829 | 17848 | TCATCTTCTTAGGCATTTCC | 45 | 849 |
| 1364119 | 1514 | 1533 | 17993 | 18012 | GCAAGAGGACCAAAGACATT | 77 | 850 |
| 1364123 | 2527 | 2546 | 19006 | 19025 | AACTGAATAGCTGATGACTG | 55 | 851 |
| 1364138 | N/A | N/A | 14242 | 14261 | ACTCAAAGCATGGATAACCC | 38 | 852 |
| 1364145 | 609 | 628 | 13597 | 13616 | CGCTCAGGCCCTTGCCGCAG | 43 | 108 |
| 1364170 | 2428 | 2447 | 18907 | 18926 | TGCTAAGTAAAATCATTTTC | 47 | 853 |
| 1364193 | 2128 | 2147 | 18607 | 18626 | CCTACGATGACTGAATGGAT | 49 | 854 |
| 1364202 | N/A | N/A | 10364 | 10383 | GCCAGGAAACTTGGCCTCTA | 22 | 855 |
| 1364204 | N/A | N/A | 11892 | 11911 | CAACTATTTATGGAATACTC | 59 | 856 |
| 1364210 | N/A | N/A | 6923 | 6942 | TTCTTTAGACCTGAAGTGCT | 85 | 857 |

TABLE 12

Reduction of PLP1 RNA by 5-10-5 MOE gapmers with mixed PO/PS internucleoside linkages in SK-MEL-28 cells

| Compound ID | SEQ ID NO: 1 Start Site | SEQ ID NO: 1 Stop Site | SEQ ID NO: 2 Start Site | SEQ ID NO: 2 Stop Site | Sequence (5' to 3') | PLP1 (% UTC) | SEQ ID No. |
|---|---|---|---|---|---|---|---|
| 1362483 | N/A | N/A | 17145 | 17164 | ACACAGCCACATCATGCAGT | 59 | 858 |
| 1362490 | 1731 | 1750 | 18210 | 18229 | GCTTCAGTAGTCCATCGCCA | 10 | 201 |
| 1362505 | N/A | N/A | 17348 | 17367 | CCATATACACTTGACTGGAA | 42 | 859 |
| 1362507 | 582 | 601 | 13570 | 13589 | TCTTGTAGTCGCCAAAGATC | 75 | 860 |
| 1362538 | N/A | N/A | 9212 | 9231 | TCAGCATAAGCATCAGATGT | 46 | 861 |
| 1362539 | 1274 | 1293 | 17753 | 17772 | GGAGAGTCCAAAGAGAGACC | 61 | 862 |
| 1362556 | 2482 | 2501 | 18961 | 18980 | CAGGAGAAAATAACCTTTAT | 15 | 863 |
| 1362557 | 1243 | 1262 | 17722 | 17741 | AAGACTCTCCTTTCTTGTTA | 52 | 864 |

TABLE 12-continued

Reduction of PLP1 RNA by 5-10-5 MOE gapmers with mixed PO/PS internucleoside linkages in SK-MEL-28 cells

| Compound ID | SEQ ID NO: 1 Start Site | SEQ ID NO: 1 Stop Site | SEQ ID NO: 2 Start Site | SEQ ID NO: 2 Stop Site | Sequence (5' to 3') | PLP1 (% UTC) | SEQ ID No. |
|---|---|---|---|---|---|---|---|
| 1362558 | 3015 | 3034 | 19494 | 19513 | TATATCAGAAATGAAGGAAA | 73 | 865 |
| 1362622 | N/A | N/A | 7890 | 7909 | CCATGAACAGAGGCCTCCTT | 84 | 866 |
| 1362647 | 2152 | 2171 | 18631 | 18650 | AAACAAATCAAGACCTTCAA | 38 | 867 |
| 1362678 | 1464 | 1483 | 17943 | 17962 | ACTTTGTTTCCATCAGTGGA | 47 | 868 |
| 1362684 | 1968 | 1987 | 18447 | 18466 | CCACCAGCAACTGCTGCTCC | 24 | 869 |
| 1362692 | 1429 | 1448 | 17908 | 17927 | GAAATTACTTTCTGATCCTC | 70 | 870 |
| 1362741 | N/A | N/A | 9613 | 9632 | ACTTGAACTCTTGCTAGCCA | 44 | 871 |
| 1362782 | N/A | N/A | 15070 | 15089 | CCCAATCATTCATCATCTTA | 55 | 872 |
| 1362821 | 1766 | 1785 | 18245 | 18264 | TCCCTTATGCTGTAAGTAAG | 32 | 873 |
| 1362829 | 303 | 322 | 12595 | 12614 | CTACCAGACATCTTGCACAG | 53 | 874 |
| 1362878 | 2229 | 2248 | 18708 | 18727 | TTATTCTCCAGACATTTCTG | 36 | 875 |
| 1362895 | 2617 | 2636 | 19096 | 19115 | CAAAGTTAACAAAAACAGGA | 71 | 876 |
| 1362911 | N/A | N/A | 6914 | 6933 | CCTGAAGTGCTGTGGGCAGG | 78 | 877 |
| 1362938 | 2255 | 2274 | 18734 | 18753 | TTTAAAAAACAGTCATAATC | 81 | 878 |
| 1362967 | 1650 | 1669 | 18129 | 18148 | TGCAATAGGCAGATTTGGGC | 22 | 200 |
| 1362973 | 1546 | 1565 | 18025 | 18044 | ACCAAAGAGAATATATTTGG | 49 | 879 |
| 1363004 | N/A | N/A | 16483 | 16502 | GCATTTCAAGGATGGAAGCA | 53 | 880 |
| 1363013 | 1999 | 2018 | 18478 | 18497 | ACCAGAGGGCCATCTCAGGT | 15 | 881 |
| 1363073 | N/A | N/A | 5811 | 5830 | ACATCAGAAGTAGTGGCAGT | 66 | 882 |
| 1363084 | 1316 | 1335 | 17795 | 17814 | ACCAGCTATGAAGCAAAATG | 30 | 883 |
| 1363104 | 2040 | 2059 | 18519 | 18538 | AAAAAAGACATGCTATCCAA | 51 | 884 |
| 1363106 | 1396 | 1415 | 17875 | 17894 | AAATTCAATTAGAGCCTCCA | 40 | 885 |
| 1363114 | 1209 | 1228 | 17688 | 17707 | GAAGAGGGCCAGTTGGTGGC | 44 | 886 |
| 1363121 | 1732 | 1751 | 18211 | 18230 | GGCTTCAGTAGTCCATCGCC | 16 | 279 |
| 1363143 | 2073 | 2092 | 18552 | 18571 | GACAGAGGCCAGAGTACACA | 10 | 887 |
| 1363159 | N/A | N/A | 10303 | 10322 | AGTTTACTCAGCATGAACTT | 85 | 888 |
| 1363168 | 1513 | 1532 | 17992 | 18011 | CAAGAGGACCAAAGACATTC | 85 | 889 |
| 1363172 | 2293 | 2312 | 18772 | 18791 | TAATATCATTTGTGATGCTT | 25 | 890 |
| 1363220 | 2662 | 2681 | 19141 | 19160 | TCTTTCCTTCAATTAAAACC | 27 | 891 |
| 1363231 | 2454 | 2473 | 18933 | 18952 | TAACTCTTAACACACCAAGA | 40 | 892 |
| 1363293 | N/A | N/A | 6299 | 6318 | CCACTTTTGGATGGAGGCAT | 38 | 893 |
| 1363294 | 2690 | 2709 | 19169 | 19188 | CTTTACAACAAAAGAACTGT | 39 | 894 |
| 1363305 | 2374 | 2393 | 18853 | 18872 | TGAGATTCAAATTCACCAAA | 22 | 895 |
| 1363306 | N/A | N/A | 16061 | 16080 | CCCTACAGTTGTGCCCAGGG | 47 | 896 |
| 1363322 | 2427 | 2446 | 18906 | 18925 | GCTAAGTAAAATCATTTTCC | 13 | 897 |
| 1363356 | 2953 | 2972 | 19432 | 19451 | TATGTATGCATGTGAGGTTT | 58 | 898 |

TABLE 12-continued

Reduction of PLP1 RNA by 5-10-5 MOE gapmers with mixed PO/PS internucleoside linkages in SK-MEL-28 cells

| Compound ID | SEQ ID NO: 1 Start Site | SEQ ID NO: 1 Stop Site | SEQ ID NO: 2 Start Site | SEQ ID NO: 2 Stop Site | Sequence (5' to 3') | PLP1 (% UTC) | SEQ ID No. |
|---|---|---|---|---|---|---|---|
| 1363421 | N/A | N/A | 8590 | 8609 | GGGAATTAAAAGGCCAGTCC | 57 | 899 |
| 1363472 | 2887 | 2906 | 19366 | 19385 | CACAAGGTACGGATTACTTC | 26 | 900 |
| 1363475 | 2786 | 2805 | 19265 | 19284 | CTGGTTTGAAAACAAGTATC | 25 | 901 |
| 1363487 | 2318 | 2337 | 18797 | 18816 | CCAATAGATTCAACTAGCCA | 29 | 56 |
| 1363528 | N/A | N/A | 11540 | 11559 | TCTTAGTTTACATATGGGAG | 38 | 902 |
| 1363577 | 2188 | 2207 | 18667 | 18686 | AAACAAACTGGAATACATGA | 53 | 903 |
| 1363590 | N/A | N/A | 16778 | 16797 | TAGTATATAGAATTCCAGGC | 23 | 904 |
| 1363601 | N/A | N/A | 5929 | 5948 | TTGTTGTAAAAATGAATCCC | 48 | 905 |
| 1363630 | 3050 | 3069 | 19529 | 19548 | AAGTTTATCCTTTATGTGTG | 36 | 906 |
| 1363666 | 2127 | 2146 | 18606 | 18625 | CTACGATGACTGAATGGATA | 44 | 907 |
| 1363675 | 3086 | 3105 | 19565 | 19584 | ATTTTATAAAATACACTTTG | 78 | 908 |
| 1363682 | N/A | N/A | 5407 | 5426 | TCCTCCAACATTCACCTCTC | 43 | 909 |
| 1363722 | 2526 | 2545 | 19005 | 19024 | ACTGAATAGCTGATGACTGG | 44 | 910 |
| 1363748 | 1827 | 1846 | 18306 | 18325 | GTTTCTCTTCCCTAACGAGG | 27 | 911 |
| 1363826 | 2836 | 2855 | 19315 | 19334 | AACATTTTCCCTCTCCTCCT | 31 | 912 |
| 1363847 | 2401 | 2420 | 18880 | 18899 | TAGAAAGAACGATCAGATTA | 66 | 913 |
| 1363883 | 2573 | 2592 | 19052 | 19071 | CAGGTCTCAAACTCTTTCTG | 18 | 914 |
| 1363902 | 2742 | 2761 | 19221 | 19240 | CATCTCCTTAAATATTGCTG | 20 | 915 |
| 1363904 | N/A | N/A | 15616 | 15635 | GAAGGCAATCGGCTAATTCA | 54 | 916 |
| 1363929 | 2343 | 2362 | 18822 | 18841 | AAAGGCAGAATACTTGTAGA | 58 | 917 |
| 1363958 | N/A | N/A | 7332 | 7351 | CTTGGCACATTGTCTCCACC | 79 | 918 |
| 1363965 | N/A | N/A | 8924 | 8943 | TCCATTTCAGAACCCCTCCT | 55 | 919 |
| 1363976 | 1585 | 1604 | 18064 | 18083 | AGTGGTAATAGAGAGACCAG | 25 | 920 |
| 1364070 | 1906 | 1925 | 18385 | 18404 | TCAGCTCCTTGGAAACCACA | 19 | 921 |
| 1364109 | 1868 | 1887 | 18347 | 18366 | TTATCAAGGAGAAGGGAGTG | 67 | 922 |
| 1364132 | N/A | N/A | 11891 | 11910 | AACTATTTATGGAATACTCA | 71 | 923 |
| 1364134 | 1694 | 1713 | 18173 | 18192 | TTTCTGTGGGTGAAAGATCC | 56 | 924 |
| 1364141 | 1347 | 1366 | 17826 | 17845 | TCTTCTTAGGCATTTCCCAT | 30 | 925 |
| 1364191 | N/A | N/A | 10875 | 10894 | GCACACACACAAATACTCAG | 34 | 926 |
| 1364208 | N/A | N/A | 14236 | 14255 | AGCATGGATAACCCTCAGGC | 18 | 927 |
| 1364218 | N/A | N/A | 5044 | 5063 | CTGTTTTACCTGAACACATG | 64 | 928 |
| 1364225 | 1076 | 1095 | 17555 | 17574 | GAGTTTAAGGACGGCAAAGT | 30 | 929 |
| 1364243 | 1177 | 1196 | 17656 | 17675 | TTAAGATGGGAGACGCAGCA | 39 | 930 |
| 1364245 | 2099 | 2118 | 18578 | 18597 | TGAAATGAGCACCATTGTGA | 42 | 931 |
| 1364247 | N/A | N/A | 4470 | 4489 | CCATAGCCAAGCCTGAGTCC | 72 | 932 |

TABLE 13

Reduction of PLP1 RNA by 5-10-5 MOE gapmers with mixed PO/PS internucleoside linkages in SK-MEL-28 cells

| Compound ID | SEQ ID NO: 1 Start Site | SEQ ID NO: 1 Stop Site | SEQ ID NO: 2 Start Site | SEQ ID NO: 2 Stop Site | Sequence (5' to 3') | PLP1 (% UTC) | SEQ ID No. |
|---|---|---|---|---|---|---|---|
| 1362426 | 2661 | 2680 | 19140 | 19159 | CTTTCCTTCAATTAAAACCA | 49 | 933 |
| 1362458 | 2225 | 2244 | 18704 | 18723 | TCTCCAGACATTTCTGATGC | 18 | 934 |
| 1362490 | 1731 | 1750 | 18210 | 18229 | GCTTCAGTAGTCCATCGCCA | 25 | 201 |
| 1362510 | 2098 | 2117 | 18577 | 18596 | GAAATGAGCACCATTGTGAA | 72 | 935 |
| 1362528 | 1241 | 1260 | 17720 | 17739 | GACTCTCCTTTCTTGTTACA | 38 | 936 |
| 1362547 | N/A | N/A | 16777 | 16796 | AGTATATAGAATTCCAGGCT | 30 | 937 |
| 1362573 | 2614 | 2633 | 19093 | 19112 | AGTTAACAAAAACAGGAAAA | 89 | 938 |
| 1362587 | N/A | N/A | 17343 | 17362 | TACACTTGACTGGAAGTCCG | 43 | 939 |
| 1362590 | 1175 | 1194 | 17654 | 17673 | AAGATGGGAGACGCAGCATT | 55 | 940 |
| 1362606 | 2342 | 2361 | 18821 | 18840 | AAGGCAGAATACTTGTAGAA | 61 | 941 |
| 1362625 | 2946 | 2965 | 19425 | 19444 | GCATGTGAGGTTTTCAGGGA | 30 | 942 |
| 1362626 | N/A | N/A | 10872 | 10891 | CACACACAAATACTCAGCAA | 53 | 943 |
| 1362644 | 2785 | 2804 | 19264 | 19283 | TGGTTTGAAAACAAGTATCA | 47 | 944 |
| 1362671 | N/A | N/A | 8923 | 8942 | CCATTTCAGAACCCCTCCTG | 81 | 945 |
| 1362680 | 2292 | 2311 | 18771 | 18790 | AATATCATTTGTGATGCTTA | 18 | 946 |
| 1362694 | N/A | N/A | 16481 | 16500 | ATTTCAAGGATGGAAGCAGT | 88 | 947 |
| 1362720 | N/A | N/A | 5761 | 5780 | CAAAGTACTTTAGATACTCT | 71 | 948 |
| 1362779 | 1545 | 1564 | 18024 | 18043 | CCAAAGAGAATATATTTGGC | 65 | 949 |
| 1362810 | 2317 | 2336 | 18796 | 18815 | CAATAGATTCAACTAGCCAA | 44 | 950 |
| 1362817 | 2571 | 2590 | 19050 | 19069 | GGTCTCAAACTCTTTCTGCC | 21 | 951 |
| 1362833 | 2740 | 2759 | 19219 | 19238 | TCTCCTTAAATATTGCTGAA | 27 | 952 |
| 1362836 | N/A | N/A | 11392 | 11411 | TCCTCCTATAATGCAGCTTG | 39 | 953 |
| 1362858 | 2125 | 2144 | 18604 | 18623 | ACGATGACTGAATGGATAAT | 41 | 954 |
| 1362902 | 1765 | 1784 | 18244 | 18263 | CCCTTATGCTGTAAGTAAGG | 27 | 126 |
| 1362936 | 3042 | 3061 | 19521 | 19540 | CCTTTATGTGTGTTAAAATT | 41 | 955 |
| 1362946 | 3081 | 3100 | 19560 | 19579 | ATAAAATACACTTTGTAAGA | 86 | 956 |
| 1362975 | N/A | N/A | 15615 | 15634 | AAGGCAATCGGCTAATTCAA | 54 | 957 |
| 1363012 | 1584 | 1603 | 18063 | 18082 | GTGGTAATAGAGAGACCAGA | 26 | 958 |
| 1363025 | 1208 | 1227 | 17687 | 17706 | AAGAGGGCCAGTTGGTGGCA | 37 | 959 |
| 1363033 | N/A | N/A | 8458 | 8477 | GCAAAATGTAAGCAAAGGGA | 60 | 960 |
| 1363105 | 1428 | 1447 | 17907 | 17926 | AAATTACTTTCTGATCCTCA | 91 | 961 |
| 1363121 | 1732 | 1751 | 18211 | 18230 | GGCTTCAGTAGTCCATCGCC | 18 | 279 |
| 1363183 | 1075 | 1094 | 17554 | 17573 | AGTTTAAGGACGGCAAAGTT | 58 | 962 |
| 1363189 | N/A | N/A | 15954 | 15973 | TTGTATATAATATCTGTTCT | 61 | 963 |
| 1363192 | 2689 | 2708 | 19168 | 19187 | TTTACAACAAAAGAACTGTA | 76 | 964 |
| 1363211 | N/A | N/A | 6295 | 6314 | TTTTGGATGGAGGCATCACA | 72 | 965 |

TABLE 13-continued

Reduction of PLP1 RNA by 5-10-5 MOE gapmers with mixed PO/PS internucleoside linkages in SK-MEL-28 cells

| Compound ID | SEQ ID NO: 1 Start Site | SEQ ID NO: 1 Stop Site | SEQ ID NO: 2 Start Site | SEQ ID NO: 2 Stop Site | Sequence (5' to 3') | PLP1 (% UTC) | SEQ ID No. |
|---|---|---|---|---|---|---|---|
| 1363214 | N/A | N/A | 14235 | 14254 | GCATGGATAACCCTCAGGCA | 27 | 966 |
| 1363215 | 2400 | 2419 | 18879 | 18898 | AGAAAGAACGATCAGATTAC | 65 | 967 |
| 1363239 | 2151 | 2170 | 18630 | 18649 | AACAAATCAAGACCTTCAAA | 63 | 968 |
| 1363255 | 1904 | 1923 | 18383 | 18402 | AGCTCCTTGGAAACCACAGG | 20 | 969 |
| 1363261 | 2187 | 2206 | 18666 | 18685 | AACAAACTGGAATACATGAA | 54 | 970 |
| 1363288 | N/A | N/A | 5403 | 5422 | CCAACATTCACCTCTCATCT | 59 | 971 |
| 1363298 | 2481 | 2500 | 18960 | 18979 | AGGAGAAAATAACCTTTATG | 40 | 972 |
| 1363355 | 1824 | 1843 | 18303 | 18322 | TCTCTTCCCTAACGAGGTGT | 36 | 53 |
| 1363359 | 2453 | 2472 | 18932 | 18951 | AACTCTTAACACACCAAGAT | 41 | 973 |
| 1363382 | 2524 | 2543 | 19003 | 19022 | TGAATAGCTGATGACTGGTG | 49 | 974 |
| 1363445 | 1463 | 1482 | 17942 | 17961 | CTTTGTTTCCATCAGTGGAA | 71 | 975 |
| 1363450 | N/A | N/A | 7773 | 7792 | AACAACAATTATCAAGAGGT | 60 | 976 |
| 1363451 | 2071 | 2090 | 18550 | 18569 | CAGAGGCCAGAGTACACAAC | 31 | 977 |
| 1363457 | 1967 | 1986 | 18446 | 18465 | CACCAGCAACTGCTGCTCCT | 29 | 978 |
| 1363476 | 3013 | 3032 | 19492 | 19511 | TATCAGAAATGAAGGAAACA | 78 | 979 |
| 1363489 | 1649 | 1668 | 18128 | 18147 | GCAATAGGCAGATTTGGGCA | 31 | 980 |
| 1363490 | N/A | N/A | 15068 | 15087 | CAATCATTCATCATCTTATA | 68 | 981 |
| 1363546 | 1273 | 1292 | 17752 | 17771 | GAGAGTCCAAAGAGAGACCT | 50 | 982 |
| 1363575 | 2828 | 2847 | 19307 | 19326 | CCCTCTCCTCCTTCTATGCA | 54 | 983 |
| 1363578 | N/A | N/A | 6800 | 6819 | GAAAGTGATGTTACTGGCTG | 52 | 984 |
| 1363595 | N/A | N/A | 5928 | 5947 | TGTTGTAAAAATGAATCCCG | 48 | 985 |
| 1363597 | 2886 | 2905 | 19365 | 19384 | ACAAGGTACGGATTACTTCA | 45 | 986 |
| 1363626 | 301 | 320 | 12593 | 12612 | ACCAGACATCTTGCACAGCA | 39 | 987 |
| 1363640 | 1315 | 1334 | 17794 | 17813 | CCAGCTATGAAGCAAAATGA | 24 | 988 |
| 1363680 | 2254 | 2273 | 18733 | 18752 | TTAAAAAACAGTCATAATCA | 86 | 989 |
| 1363685 | 2426 | 2445 | 18905 | 18924 | CTAAGTAAAATCATTTTCCA | 18 | 990 |
| 1363694 | 1346 | 1365 | 17825 | 17844 | CTTCTTAGGCATTTCCCATT | 40 | 991 |
| 1363720 | 1692 | 1711 | 18171 | 18190 | TCTGTGGGTGAAAGATCCTT | 33 | 992 |
| 1363762 | 1998 | 2017 | 18477 | 18496 | CCAGAGGGCCATCTCAGGTT | 22 | 993 |
| 1363841 | N/A | N/A | 5041 | 5060 | TTTTACCTGAACACATGCTT | 85 | 994 |
| 1363885 | 573 | 592 | 13561 | 13580 | CGCCAAAGATCTGCCTGACT | 61 | 995 |
| 1364003 | N/A | N/A | 9601 | 9620 | GCTAGCCAAAAGAGAACTCC | 86 | 996 |
| 1364031 | N/A | N/A | 17018 | 17037 | TGTCTGATCACTGCTTATAA | 44 | 997 |
| 1364043 | N/A | N/A | 9206 | 9225 | TAAGCATCAGATGTTCATCT | 42 | 998 |
| 1364044 | N/A | N/A | 11881 | 11900 | GGAATACTCACTATATGCCC | 49 | 999 |
| 1364049 | 1866 | 1885 | 18345 | 18364 | ATCAAGGAGAAGGGAGTGAG | 50 | 1000 |

TABLE 13-continued

Reduction of PLP1 RNA by 5-10-5 MOE gapmers with mixed PO/PS internucleoside linkages in SK-MEL-28 cells

| Compound ID | SEQ ID NO: 1 Start Site | SEQ ID NO: 1 Stop Site | SEQ ID NO: 2 Start Site | SEQ ID NO: 2 Stop Site | Sequence (5' to 3') | PLP1 (% UTC) | SEQ ID No. |
|---|---|---|---|---|---|---|---|
| 1364101 | 2039 | 2058 | 18518 | 18537 | AAAAAGACATGCTATCCAAA | 57 | 1001 |
| 1364131 | N/A | N/A | 10296 | 10315 | TCAGCATGAACTTTGCAAAC | 76 | 1002 |
| 1364136 | N/A | N/A | 4469 | 4488 | CATAGCCAAGCCTGAGTCCA | 88 | 1003 |
| 1364175 | 1512 | 1531 | 17991 | 18010 | AAGAGGACCAAAGACATTCC | 59 | 1004 |
| 1364182 | 2373 | 2392 | 18852 | 18871 | GAGATTCAAATTCACCAAAT | 16 | 1005 |
| 1364188 | N/A | N/A | 7288 | 7307 | GGGAAGTAACTGGTACTAGA | 57 | 1006 |
| 1364265 | 1395 | 1414 | 17874 | 17893 | AATTCAATTAGAGCCTCCAT | 48 | 1007 |

TABLE 14

Reduction of PLP1 RNA by 5-10-5 MOE gapmers with mixed PO/PS internucleoside linkages in SK-MEL-28 cells

| Compound ID | SEQ ID NO: 1 Start Site | SEQ ID NO: 1 Stop Site | SEQ ID NO: 2 Start Site | SEQ ID NO: 2 Stop Site | Sequence (5' to 3') | PLP1 (% UTC) | SEQ ID No. |
|---|---|---|---|---|---|---|---|
| 1362486 | 2827 | 2846 | 19306 | 19325 | CCTCTCCTCCTTCTATGCAG | 30 | 1008 |
| 1362490 | 1731 | 1750 | 18210 | 18229 | GCTTCAGTAGTCCATCGCCA | 12 | 201 |
| 1362511 | N/A | N/A | 8895 | 8914 | GGTGTGAGTTTGATTCAAGA | 64 | 1009 |
| 1362514 | 2038 | 2057 | 18517 | 18536 | AAAAGACATGCTATCCAAAG | 68 | 1010 |
| 1362521 | 2150 | 2169 | 18629 | 18648 | ACAAATCAAGACCTTCAAAT | 57 | 1011 |
| 1362527 | N/A | N/A | 15952 | 15971 | GTATATAATATCTGTTCTCA | 39 | 1012 |
| 1362582 | 2372 | 2391 | 18851 | 18870 | AGATTCAAATTCACCAAATC | 38 | 1013 |
| 1362630 | 2945 | 2964 | 19424 | 19443 | CATGTGAGGTTTTCAGGGAA | 36 | 1014 |
| 1362683 | 1544 | 1563 | 18023 | 18042 | CAAAGAGAATATATTTGGCC | 69 | 1015 |
| 1362703 | 1207 | 1226 | 17686 | 17705 | AGAGGGCCAGTTGGTGGCAA | 55 | 1016 |
| 1362758 | 2784 | 2803 | 19263 | 19282 | GGTTTGAAAACAAGTATCAA | 35 | 1017 |
| 1362792 | 1865 | 1884 | 18344 | 18363 | TCAAGGAGAAGGGAGTGAGA | 45 | 1018 |
| 1362806 | 2885 | 2904 | 19364 | 19383 | CAAGGTACGGATTACTTCAC | 36 | 1019 |
| 1362843 | 2425 | 2444 | 18904 | 18923 | TAAGTAAAATCATTTTCCAT | 56 | 1020 |
| 1362854 | 2452 | 2471 | 18931 | 18950 | ACTCTTAACACACCAAGATA | 52 | 1021 |
| 1362856 | 2289 | 2308 | 18768 | 18787 | ATCATTTGTGATGCTTAATG | 11 | 1022 |
| 1362877 | N/A | N/A | 4403 | 4422 | GTTTGCATCAAGCAAGCAGT | 40 | 1023 |
| 1362887 | 2688 | 2707 | 19167 | 19186 | TTACAACAAAAGAACTGTAG | 65 | 1024 |
| 1362908 | 1462 | 1481 | 17941 | 17960 | TTTGTTTCCATCAGTGGAAG | 72 | 1025 |
| 1362932 | N/A | N/A | 5927 | 5946 | GTTGTAAAAATGAATCCCGC | 35 | 1026 |
| 1362934 | N/A | N/A | 10871 | 10890 | ACACACAAATACTCAGCAAA | 58 | 1027 |
| 1362953 | N/A | N/A | 6796 | 6815 | GTGATGTTACTGGCTGGAGT | 52 | 1028 |

TABLE 14-continued

Reduction of PLP1 RNA by 5-10-5 MOE gapmers with mixed PO/PS internucleoside linkages in SK-MEL-28 cells

| Compound ID | SEQ ID NO: 1 Start Site | SEQ ID NO: 1 Stop Site | SEQ ID NO: 2 Start Site | SEQ ID NO: 2 Stop Site | Sequence (5' to 3') | PLP1 (% UTC) | SEQ ID No. |
|---|---|---|---|---|---|---|---|
| 1362963 | 1648 | 1667 | 18127 | 18146 | CAATAGGCAGATTTGGGCAA | 47 | 1029 |
| 1362966 | N/A | N/A | 15608 | 15627 | TCGGCTAATTCAAAATCCAG | 37 | 1030 |
| 1362978 | N/A | N/A | 16478 | 16497 | TCAAGGATGGAAGCAGTCTA | 77 | 1031 |
| 1362983 | 299 | 318 | 12591 | 12610 | CAGACATCTTGCACAGCACT | 34 | 1032 |
| 1363008 | 3079 | 3098 | 19558 | 19577 | AAAATACACTTTGTAAGATA | 80 | 1033 |
| 1363051 | 1822 | 1841 | 18301 | 18320 | TCTTCCCTAACGAGGTGTAA | 31 | 1034 |
| 1363064 | N/A | N/A | 11880 | 11899 | GAATACTCACTATATGCCCA | 65 | 1035 |
| 1363101 | 1903 | 1922 | 18382 | 18401 | GCTCCTTGGAAACCACAGGG | 23 | 1036 |
| 1363115 | N/A | N/A | 14089 | 14108 | AGATCAGGTGCCCAAGTCTC | 43 | 1037 |
| 1363121 | 1732 | 1751 | 18211 | 18230 | GGCTTCAGTAGTCCATCGCC | 12 | 279 |
| 1363129 | N/A | N/A | 7771 | 7790 | CAACAATTATCAAGAGGTGC | 40 | 1038 |
| 1363144 | 2253 | 2272 | 18732 | 18751 | TAAAAAACAGTCATAATCAA | 107 | 1039 |
| 1363167 | 2097 | 2116 | 18576 | 18595 | AAATGAGCACCATTGTGAAG | 68 | 1040 |
| 1363187 | 1583 | 1602 | 18062 | 18081 | TGGTAATAGAGAGACCAGAA | 29 | 1041 |
| 1363283 | 1314 | 1333 | 17793 | 17812 | CAGCTATGAAGCAAAATGAC | 50 | 1042 |
| 1363287 | 2070 | 2089 | 18549 | 18568 | AGAGGCCAGAGTACACAACT | 18 | 1043 |
| 1363290 | 1394 | 1413 | 17873 | 17892 | ATTCAATTAGAGCCTCCATT | 60 | 1044 |
| 1363311 | 1272 | 1291 | 17751 | 17770 | AGAGTCCAAAGAGAGACCTT | 51 | 1045 |
| 1363320 | N/A | N/A | 5038 | 5057 | TACCTGAACACATGCTTCAA | 87 | 1046 |
| 1363351 | 2224 | 2243 | 18703 | 18722 | CTCCAGACATTTCTGATGCA | 20 | 1047 |
| 1363389 | 1174 | 1193 | 17653 | 17672 | AGATGGGAGACGCAGCATTG | 50 | 1048 |
| 1363395 | N/A | N/A | 5758 | 5777 | AGTACTTTAGATACTCTGTT | 24 | 1049 |
| 1363398 | N/A | N/A | 9203 | 9222 | GCATCAGATGTTCATCTCTT | 22 | 1050 |
| 1363408 | N/A | N/A | 10147 | 10166 | AAATCGATTGTTGTTCTCAG | 60 | 1051 |
| 1363453 | 2569 | 2588 | 19048 | 19067 | TCTCAAACTCTTTCTGCCTG | 24 | 1052 |
| 1363460 | 872 | 891 | 14931 | 14950 | AGCACAGAGACTGCCTATAC | 67† | 1053 |
| 1363467 | 2124 | 2143 | 18603 | 18622 | CGATGACTGAATGGATAATA | 28 | 1054 |
| 1363513 | 572 | 591 | 13560 | 13579 | GCCAAAGATCTGCCTGACTG | 45 | 1055 |
| 1363534 | 2399 | 2418 | 18878 | 18897 | GAAAGAACGATCAGATTACT | 53 | 1056 |
| 1363558 | 1427 | 1446 | 17906 | 17925 | AATTACTTTCTGATCCTCAG | 88 | 1057 |
| 1363559 | N/A | N/A | 16776 | 16795 | GTATATAGAATTCCAGGCTA | 32 | 1058 |
| 1363570 | 1997 | 2016 | 18476 | 18495 | CAGAGGGCCATCTCAGGTTA | 45 | 1059 |
| 1363642 | 2523 | 2542 | 19002 | 19021 | GAATAGCTGATGACTGGTGC | 23 | 1060 |
| 1363651 | 1239 | 1258 | 17718 | 17737 | CTCTCCTTTCTTGTTACACT | 36 | 1061 |
| 1363716 | 2480 | 2499 | 18959 | 18978 | GGAGAAAATAACCTTTATGT | 33 | 1062 |
| 1363735 | 2184 | 2203 | 18663 | 18682 | AAACTGGAATACATGAAATG | 73 | 1063 |

TABLE 14-continued

Reduction of PLP1 RNA by 5-10-5 MOE gapmers with mixed PO/PS internucleoside linkages in SK-MEL-28 cells

| Compound ID | SEQ ID NO: 1 Start Site | SEQ ID NO: 1 Stop Site | SEQ ID NO: 2 Start Site | SEQ ID NO: 2 Stop Site | Sequence (5' to 3') | PLP1 (% UTC) | SEQ ID No. |
|---|---|---|---|---|---|---|---|
| 1363737 | N/A | N/A | 11389 | 11408 | TCCTATAATGCAGCTTGGCT | 60 | 1064 |
| 1363760 | 2316 | 2335 | 18795 | 18814 | AATAGATTCAACTAGCCAAT | 48 | 1065 |
| 1363809 | 3041 | 3060 | 19520 | 19539 | CTTTATGTGTGTTAAAATTG | 72 | 1066 |
| 1363812 | 2739 | 2758 | 19218 | 19237 | CTCCTTAAATATTGCTGAAA | 32 | 1067 |
| 1363817 | N/A | N/A | 5402 | 5421 | CAACATTCACCTCTCATCTG | 77 | 1068 |
| 1363831 | N/A | N/A | 9597 | 9616 | GCCAAAAGAGAACTCCACTT | 49 | 1069 |
| 1363836 | 3012 | 3031 | 19491 | 19510 | ATCAGAAATGAAGGAAACAC | 61 | 1070 |
| 1363846 | 2341 | 2360 | 18820 | 18839 | AGGCAGAATACTTGTAGAAA | 58 | 1071 |
| 1363848 | 1691 | 1710 | 18170 | 18189 | CTGTGGGTGAAAGATCCTTG | 29 | 1072 |
| 1363854 | N/A | N/A | 7272 | 7291 | TAGAGACAATAGTAGCCATA | 73 | 1073 |
| 1363886 | N/A | N/A | 16994 | 17013 | ACTTCAGATAAATCACTTCA | 53 | 1074 |
| 1364056 | N/A | N/A | 17340 | 17359 | ACTTGACTGGAAGTCCGATG | 29 | 1075 |
| 1364078 | 2613 | 2632 | 19092 | 19111 | GTTAACAAAAACAGGAAAAG | 79 | 1076 |
| 1364079 | 1511 | 1530 | 17990 | 18009 | AGAGGACCAAAGACATTCCT | 48 | 1077 |
| 1364086 | N/A | N/A | 8419 | 8438 | GCTACATTTGTATACAAACT | 36 | 1078 |
| 1364091 | 1074 | 1093 | 17553 | 17572 | GTTTAAGGACGGCAAAGTTG | 55 | 1079 |
| 1364126 | N/A | N/A | 6291 | 6310 | GGATGGAGGCATCACAGTCT | 47 | 1080 |
| 1364129 | 1762 | 1781 | 18241 | 18260 | TTATGCTGTAAGTAAGGTTG | 42 | 1081 |
| 1364192 | 1966 | 1985 | 18445 | 18464 | ACCAGCAACTGCTGCTCCTC | 33 | 1082 |
| 1364205 | 2658 | 2677 | 19137 | 19156 | TCCTTCAATTAAAACCAATC | 38 | 1083 |
| 1364244 | 1345 | 1364 | 17824 | 17843 | TTCTTAGGCATTTCCCATTT | 52 | 1084 |

TABLE 15

Reduction of PLP1 RNA by 5-10-5 MOE gapmers with mixed PO/PS internucleoside linkages in SK-MEL-28 cells

| Compound ID | SEQ ID NO: 1 Start Site | SEQ ID NO: 1 Stop Site | SEQ ID NO: 2 Start Site | SEQ ID NO: 2 Stop Site | Sequence (5' to 3') | PLP1 (% UTC) | SEQ ID No. |
|---|---|---|---|---|---|---|---|
| 1362433 | 296 | 315 | 12588 | 12607 | ACATCTTGCACAGCACTCTA | 34 | 1085 |
| 1362442 | N/A | N/A | 5303 | 5322 | CTGTATACACATTATTGTCT | 46 | 1086 |
| 1362446 | 1864 | 1883 | 18343 | 18362 | CAAGGAGAAGGGAGTGAGAA | 60 | 1087 |
| 1362448 | 1234 | 1253 | 17713 | 17732 | CTTTCTTGTTACACTCATCA | 28 | 1088 |
| 1362450 | 2783 | 2802 | 19262 | 19281 | GTTTGAAAACAAGTATCAAG | 29 | 1089 |
| 1362460 | 2520 | 2539 | 18999 | 19018 | TAGCTGATGACTGGTGCATT | 26 | 1090 |
| 1362485 | 2738 | 2757 | 19217 | 19236 | TCCTTAAATATTGCTGAAAC | 40 | 1091 |
| 1362490 | 1731 | 1750 | 18210 | 18229 | GCTTCAGTAGTCCATCGCCA | 13 | 201 |

TABLE 15-continued

| Compound ID | SEQ ID NO: 1 Start Site | SEQ ID NO: 1 Stop Site | SEQ ID NO: 2 Start Site | SEQ ID NO: 2 Stop Site | Sequence (5' to 3') | PLP1 (% UTC) | SEQ ID No. |
|---|---|---|---|---|---|---|---|
| Reduction of PLP1 RNA by 5-10-5 MOE gapmers with mixed PO/PS internucleoside linkages in SK-MEL-28 cells | | | | | | | |
| 1362516 | N/A | N/A | 10143 | 10162 | CGATTGTTGTTCTCAGAAAA | 49 | 1092 |
| 1362738 | 2183 | 2202 | 18662 | 18681 | AACTGGAATACATGAAATGT | 78 | 1093 |
| 1362745 | N/A | N/A | 8416 | 8435 | ACATTTGTATACAAACTCCC | 46 | 1094 |
| 1362767 | N/A | N/A | 17254 | 17273 | CCTCTGTTTGATCTAGCACT | 31 | 1095 |
| 1362816 | 2657 | 2676 | 19136 | 19155 | CCTTCAATTAAAACCAATCA | 39 | 1096 |
| 1362825 | N/A | N/A | 16765 | 16784 | TCCAGGCTATAGCAAGTCAT | 23 | 1097 |
| 1362857 | 1073 | 1092 | 17552 | 17571 | TTTAAGGACGGCAAAGTTGT | 66 | 1098 |
| 1362866 | N/A | N/A | 14042 | 14061 | TGTCCAGTTAGATCCACTCT | 16 | 245 |
| 1362899 | N/A | N/A | 10870 | 10889 | CACACAAATACTCAGCAAAT | 66 | 1099 |
| 1362916 | 1205 | 1224 | 17684 | 17703 | AGGGCCAGTTGGTGGCAAAG | 34 | 1100 |
| 1362951 | 3039 | 3058 | 19518 | 19537 | TTATGTGTGTTAAAATTGCA | 55 | 1101 |
| 1362982 | N/A | N/A | 11388 | 11407 | CCTATAATGCAGCTTGGCTA | 54 | 1102 |
| 1363000 | N/A | N/A | 5037 | 5056 | ACCTGAACACATGCTTCAAA | 59 | 1103 |
| 1363031 | N/A | N/A | 5728 | 5747 | TGAAAACTCAGTGGCTGCTC | 47 | 1104 |
| 1363039 | 2315 | 2334 | 18794 | 18813 | ATAGATTCAACTAGCCAATT | 61 | 1105 |
| 1363059 | 2037 | 2056 | 18516 | 18535 | AAAGACATGCTATCCAAAGA | 46 | 1106 |
| 1363100 | 1543 | 1562 | 18022 | 18041 | AAAGAGAATATATTTGGCCC | 58 | 1107 |
| 1363121 | 1732 | 1751 | 18211 | 18230 | GGCTTCAGTAGTCCATCGCC | 15 | 279 |
| 1363145 | 2069 | 2088 | 18548 | 18567 | GAGGCCAGAGTACACAACTA | 15 | 1108 |
| 1363151 | 2371 | 2390 | 18850 | 18869 | GATTCAAATTCACCAAATCT | 28 | 1109 |
| 1363179 | 2223 | 2242 | 18702 | 18721 | TCCAGACATTTCTGATGCAA | 14 | 1110 |
| 1363199 | N/A | N/A | 16993 | 17012 | CTTCAGATAAATCACTTCAC | 40 | 1111 |
| 1363216 | N/A | N/A | 7714 | 7733 | TGGTCAGACAATGCCCTGCC | 56 | 1112 |
| 1363221 | N/A | N/A | 16474 | 16493 | GGATGGAAGCAGTCTACCTT | 44 | 1113 |
| 1363234 | 1343 | 1362 | 17822 | 17841 | CTTAGGCATTTCCCATTTCT | 47 | 1114 |
| 1363237 | 3011 | 3030 | 19490 | 19509 | TCAGAAATGAAGGAAACACT | 51 | 1115 |
| 1363248 | 1425 | 1444 | 17904 | 17923 | TTACTTTCTGATCCTCAGGA | 66 | 1116 |
| 1363273 | 1459 | 1478 | 17938 | 17957 | GTTTCCATCAGTGGAAGTAC | 16 | 1117 |
| 1363292 | 2929 | 2948 | 19408 | 19427 | GGAAGGGTTGGTTATTTGTT | 41 | 1118 |
| 1363338 | N/A | N/A | 7271 | 7290 | AGAGACAATAGTAGCCATAC | 69 | 1119 |
| 1363357 | 2286 | 2305 | 18765 | 18784 | ATTTGTGATGCTTAATGTCC | 30 | 1120 |
| 1363361 | 1901 | 1920 | 18380 | 18399 | TCCTTGGAAACCACAGGGTT | 49 | 1121 |
| 1363424 | N/A | N/A | 9511 | 9530 | TGATCCCTCAATCATCATCC | 56 | 1122 |
| 1363486 | N/A | N/A | 15607 | 15626 | CGGCTAATTCAAAATCCAGC | 19 | 1123 |
| 1363516 | N/A | N/A | 9199 | 9218 | CAGATGTTCATCTCTTCACA | 35 | 1124 |
| 1363518 | 1821 | 1840 | 18300 | 18319 | CTTCCCTAACGAGGTGTAAG | 33 | 1125 |

TABLE 15-continued

Reduction of PLP1 RNA by 5-10-5 MOE gapmers with mixed PO/PS internucleoside linkages in SK-MEL-28 cells

| Compound ID | SEQ ID NO: 1 Start Site | SEQ ID NO: 1 Stop Site | SEQ ID NO: 2 Start Site | SEQ ID NO: 2 Stop Site | Sequence (5' to 3') | PLP1 (% UTC) | SEQ ID No. |
|---|---|---|---|---|---|---|---|
| 1363519 | 1994 | 2013 | 18473 | 18492 | AGGGCCATCTCAGGTTACAC | 10 | 288 |
| 1363521 | N/A | N/A | 5912 | 5931 | CCCGCATTGAAGGTTGGCTC | 32 | 1126 |
| 1363584 | 2398 | 2417 | 18877 | 18896 | AAAGAACGATCAGATTACTC | 28 | 1127 |
| 1363598 | 2122 | 2141 | 18601 | 18620 | ATGACTGAATGGATAATACC | 37 | 1128 |
| 1363638 | 2823 | 2842 | 19302 | 19321 | TCCTCCTTCTATGCAGCCTG | 21 | 1129 |
| 1363646 | N/A | N/A | 6282 | 6301 | CATCACAGTCTGGTTACCAG | 68 | 1130 |
| 1363648 | 1965 | 1984 | 18444 | 18463 | CCAGCAACTGCTGCTCCTCA | 17 | 1131 |
| 1363655 | 871 | 890 | 14930 | 14949 | GCACAGAGACTGCCTATACT | 77† | 1132 |
| 1363663 | 478 | 497 | 13466 | 13485 | ACATACTGGAAGGCATGGAT | 36 | 1133 |
| 1363693 | N/A | N/A | 8893 | 8912 | TGTGAGTTTGATTCAAGAAG | 52 | 1134 |
| 1363714 | 1393 | 1412 | 17872 | 17891 | TTCAATTAGAGCCTCCATTC | 50 | 1135 |
| 1363744 | 2884 | 2903 | 19363 | 19382 | AAGGTACGGATTACTTCACT | 26 | 1136 |
| 1363764 | 1271 | 1290 | 17750 | 17769 | GAGTCCAAAGAGAGACCTTA | 43 | 1137 |
| 1363835 | 2566 | 2585 | 19045 | 19064 | CAAACTCTTTCTGCCTGTCC | 31 | 1138 |
| 1363866 | 3078 | 3097 | 19557 | 19576 | AAATACACTTTGTAAGATAA | 55 | 1139 |
| 1363920 | N/A | N/A | 6767 | 6786 | ATGGGTTTGGAGACTATATT | 61 | 1140 |
| 1363945 | 2612 | 2631 | 19091 | 19110 | TTAACAAAAACAGGAAAAGA | 86 | 1141 |
| 1363952 | 2687 | 2706 | 19166 | 19185 | TACAACAAAAGAACTGTAGT | 49 | 1142 |
| 1363971 | 1582 | 1601 | 18061 | 18080 | GGTAATAGAGAGACCAGAAT | 21 | 1143 |
| 1363996 | 2451 | 2470 | 18930 | 18949 | CTCTTAACACACCAAGATAA | 58 | 1144 |
| 1364006 | N/A | N/A | 15913 | 15932 | AAATGTACTTATTTTACCTC | 65 | 1145 |
| 1364054 | 1313 | 1332 | 17792 | 17811 | AGCTATGAAGCAAAATGACT | 41 | 1146 |
| 1364059 | 2424 | 2443 | 18903 | 18922 | AAGTAAAATCATTTTCCATT | 47 | 1147 |
| 1364082 | 2096 | 2115 | 18575 | 18594 | AATGAGCACCATTGTGAAGA | 44 | 1148 |
| 1364083 | 1647 | 1666 | 18126 | 18145 | AATAGGCAGATTTGGGCAAA | 36 | 1149 |
| 1364135 | N/A | N/A | 11875 | 11894 | CTCACTATATGCCCAGCATT | 66 | 1150 |
| 1364140 | 2479 | 2498 | 18958 | 18977 | GAGAAAATAACCTTTATGTT | 56 | 1151 |
| 1364160 | N/A | N/A | 4399 | 4418 | GCATCAAGCAAGCAGTTATT | 23 | 1152 |
| 1364161 | 2340 | 2359 | 18819 | 18838 | GGCAGAATACTTGTAGAAAA | 28 | 1153 |
| 1364217 | 2149 | 2168 | 18628 | 18647 | CAAATCAAGACCTTCAAATC | 68 | 1154 |
| 1364224 | 1173 | 1192 | 17652 | 17671 | GATGGGAGACGCAGCATTGT | 58 | 1155 |
| 1364227 | 1760 | 1779 | 18239 | 18258 | ATGCTGTAAGTAAGGTTGGC | 24 | 281 |
| 1364229 | 1689 | 1708 | 18168 | 18187 | GTGGGTGAAAGATCCTTGCT | 26 | 1156 |
| 1364242 | 1510 | 1529 | 17989 | 18008 | GAGGACCAAAGACATTCCTT | 49 | 1157 |
| 1364264 | 2252 | 2271 | 18731 | 18750 | AAAAAACAGTCATAATCAAA | 118 | 1158 |

TABLE 16

Reduction of PLP1 RNA by 5-10-5 MOE gapmers with mixed PO/PS internucleoside linkages in SK-MEL-28 cells

| Compound ID | SEQ ID NO: 1 Start Site | SEQ ID NO: 1 Stop Site | SEQ ID NO: 2 Start Site | SEQ ID NO: 2 Stop Site | Sequence (5' to 3') | PLP1 (% UTC) | SEQ ID No. |
|---|---|---|---|---|---|---|---|
| 1362429 | 1820 | 1839 | 18299 | 18318 | TTCCCTAACGAGGTGTAAGG | 34 | 1159 |
| 1362430 | 863 | 882 | 14922 | 14941 | ACTGCCTATACTGGCAGAGG | 70 | 1160 |
| 1362465 | 2181 | 2200 | 18660 | 18679 | CTGGAATACATGAAATGTGC | 30 | 1161 |
| 1362490 | 1731 | 1750 | 18210 | 18229 | GCTTCAGTAGTCCATCGCCA | 15 | 201 |
| 1362492 | 2565 | 2584 | 19044 | 19063 | AAACTCTTTCTGCCTGTCCT | 26 | 1162 |
| 1362515 | 2370 | 2389 | 18849 | 18868 | ATTCAAATTCACCAAATCTG | 45 | 1163 |
| 1362526 | 2880 | 2899 | 19359 | 19378 | TACGGATTACTTCACTGTCC | 27 | 58 |
| 1362676 | 2478 | 2497 | 18957 | 18976 | AGAAAATAACCTTTATGTTA | 83 | 1164 |
| 1362682 | N/A | N/A | 8412 | 8431 | TTGTATACAAACTCCCAAAA | 69 | 1165 |
| 1362701 | 3010 | 3029 | 19489 | 19508 | CAGAAATGAAGGAAACACTT | 34 | 1166 |
| 1362725 | N/A | N/A | 4382 | 4401 | ATTTTGTACATCTGAGGGCT | 72 | 1167 |
| 1362726 | 2397 | 2416 | 18876 | 18895 | AAGAACGATCAGATTACTCA | 34 | 1168 |
| 1362770 | 1688 | 1707 | 18167 | 18186 | TGGGTGAAAGATCCTTGCTT | 32 | 1169 |
| 1362796 | N/A | N/A | 17246 | 17265 | TGATCTAGCACTGAGTTTTC | 69 | 1170 |
| 1362801 | N/A | N/A | 6275 | 6294 | GTCTGGTTACCAGGGTAACA | 28 | 1171 |
| 1362814 | N/A | N/A | 16992 | 17011 | TTCAGATAAATCACTTCACC | 62 | 1172 |
| 1362864 | 2035 | 2054 | 18514 | 18533 | AGACATGCTATCCAAAGAGT | 53 | 1173 |
| 1362909 | N/A | N/A | 14041 | 14060 | GTCCAGTTAGATCCACTCTT | 13 | 167 |
| 1362976 | N/A | N/A | 11326 | 11345 | GCTACAAACAGACTTTATAC | 69 | 1174 |
| 1362984 | N/A | N/A | 10139 | 10158 | TGTTGTTCTCAGAAAACATT | 70 | 1175 |
| 1362986 | 1458 | 1477 | 17937 | 17956 | TTTCCATCAGTGGAAGTACC | 66 | 1176 |
| 1362994 | 1204 | 1223 | 17683 | 17702 | GGGCCAGTTGGTGGCAAAGG | 36 | 1177 |
| 1362997 | N/A | N/A | 8889 | 8908 | AGTTTGATTCAAGAAGGCTG | 52 | 1178 |
| 1362999 | 2095 | 2114 | 18574 | 18593 | ATGAGCACCATTGTGAAGAT | 32 | 1179 |
| 1363005 | N/A | N/A | 9425 | 9444 | TTCTGAGTCACCAGATCATA | 78 | 1180 |
| 1363007 | 2517 | 2536 | 18996 | 19015 | CTGATGACTGGTGCATTCTG | 24 | 1181 |
| 1363009 | N/A | N/A | 12528 | 12547 | CCAGTAGGTAGCTCATGCCA | 93 | 1182 |
| 1363029 | 1312 | 1331 | 17791 | 17810 | GCTATGAAGCAAAATGACTA | 39 | 1183 |
| 1363052 | N/A | N/A | 16764 | 16783 | CCAGGCTATAGCAAGTCATG | 33 | 1184 |
| 1363060 | 2782 | 2801 | 19261 | 19280 | TTTGAAAACAAGTATCAAGT | 60 | 1185 |
| 1363068 | N/A | N/A | 13455 | 13474 | GGCATGGATCCTGCATTAAC | 73 | 1186 |
| 1363083 | 1423 | 1442 | 17902 | 17921 | ACTTTCTGATCCTCAGGAGA | 87 | 1187 |
| 1363121 | 1732 | 1751 | 18211 | 18230 | GGCTTCAGTAGTCCATCGCC | 22 | 279 |
| 1363127 | N/A | N/A | 10862 | 10881 | TACTCAGCAAATGTACTGGG | 46 | 1188 |
| 1363139 | 3077 | 3096 | 19556 | 19575 | AATACACTTTGTAAGATAAG | 70 | 1189 |
| 1363154 | 1270 | 1289 | 17749 | 17768 | AGTCCAAAGAGAGACCTTAA | 70 | 1190 |

TABLE 16-continued

Reduction of PLP1 RNA by 5-10-5 MOE gapmers with mixed PO/PS internucleoside linkages in SK-MEL-28 cells

| Compound ID | SEQ ID NO: 1 Start Site | SEQ ID NO: 1 Stop Site | SEQ ID NO: 2 Start Site | SEQ ID NO: 2 Stop Site | Sequence (5' to 3') | PLP1 (% UTC) | SEQ ID No. |
|---|---|---|---|---|---|---|---|
| 1363196 | 2819 | 2838 | 19298 | 19317 | CCTTCTATGCAGCCTGGAAG | 13 | 1191 |
| 1363204 | 1072 | 1091 | 17551 | 17570 | TTAAGGACGGCAAAGTTGTA | 78 | 1192 |
| 1363227 | 2928 | 2947 | 19407 | 19426 | GAAGGGTTGGTTATTTGTTA | 55 | 1193 |
| 1363245 | 1392 | 1411 | 17871 | 17890 | TCAATTAGAGCCTCCATTCC | 64 | 1194 |
| 1363247 | 2314 | 2333 | 18793 | 18812 | TAGATTCAACTAGCCAATTT | 71 | 1195 |
| 1363253 | 1646 | 1665 | 18125 | 18144 | ATAGGCAGATTTGGGCAAAC | 42 | 1196 |
| 1363337 | 1542 | 1561 | 18021 | 18040 | AAGAGAATATATTTGGCCCC | 62 | 1197 |
| 1363391 | 2285 | 2304 | 18764 | 18783 | TTTGTGATGCTTAATGTCCA | 20 | 1198 |
| 1363422 | 2067 | 2086 | 18546 | 18565 | GGCCAGAGTACACAACTAAT | 32 | 1199 |
| 1363429 | 1758 | 1777 | 18237 | 18256 | GCTGTAAGTAAGGTTGGCTG | 15 | 125 |
| 1363431 | 1993 | 2012 | 18472 | 18491 | GGGCCATCTCAGGTTACACC | 17 | 1200 |
| 1363452 | 3036 | 3055 | 19515 | 19534 | TGTGTGTTAAAATTGCAATT | 20 | 1201 |
| 1363479 | 2423 | 2442 | 18902 | 18921 | AGTAAAATCATTTTCCATTA | 44 | 1202 |
| 1363501 | 2251 | 2270 | 18730 | 18749 | AAAAACAGTCATAATCAAAG | 77 | 1203 |
| 1363523 | 2148 | 2167 | 18627 | 18646 | AAATCAAGACCTTCAAATCA | 71 | 1204 |
| 1363524 | 2450 | 2469 | 18929 | 18948 | TCTTAACACACCAAGATAAC | 79 | 1205 |
| 1363531 | 2609 | 2628 | 19088 | 19107 | ACAAAAACAGGAAAAGACTG | 91 | 1206 |
| 1363566 | 1900 | 1919 | 18379 | 18398 | CCTTGGAAACCACAGGGTTG | 46 | 1207 |
| 1363580 | 1861 | 1880 | 18340 | 18359 | GGAGAAGGGAGTGAGAAGAT | 56 | 1208 |
| 1363622 | 1172 | 1191 | 17651 | 17670 | ATGGGAGACGCAGCATTGTA | 56 | 1209 |
| 1363635 | 2737 | 2756 | 19216 | 19235 | CCTTAAATATTGCTGAAACC | 44 | 1210 |
| 1363647 | N/A | N/A | 5036 | 5055 | CCTGAACACATGCTTCAAAG | 73 | 1211 |
| 1363729 | N/A | N/A | 5727 | 5746 | GAAAACTCAGTGGCTGCTCC | 41 | 1212 |
| 1363733 | N/A | N/A | 9155 | 9174 | GGGCATTTAAGTTCAGCAGA | 45 | 1213 |
| 1363768 | 1342 | 1361 | 17821 | 17840 | TTAGGCATTTCCCATTTCTA | 40 | 1214 |
| 1363770 | N/A | N/A | 11874 | 11893 | TCACTATATGCCCAGCATTA | 103 | 1215 |
| 1363794 | N/A | N/A | 7270 | 7289 | GAGACAATAGTAGCCATACC | 68 | 1216 |
| 1363840 | 1581 | 1600 | 18060 | 18079 | GTAATAGAGAGACCAGAATG | 55 | 1217 |
| 1363887 | 1961 | 1980 | 18440 | 18459 | CAACTGCTGCTCCTCAGGCC | 23 | 1218 |
| 1363903 | N/A | N/A | 15907 | 15926 | ACTTATTTTACCTCTCATTT | 57 | 1219 |
| 1363915 | N/A | N/A | 7700 | 7719 | CCTGCCTATAATCTTGTCTT | 72 | 1220 |
| 1363935 | 2121 | 2140 | 18600 | 18619 | TGACTGAATGGATAATACCC | 25 | 1221 |
| 1363964 | N/A | N/A | 6763 | 6782 | GTTTGGAGACTATATTTCCC | 67 | 1222 |
| 1363994 | 1232 | 1251 | 17711 | 17730 | TTCTTGTTACACTCATCAAG | 45 | 1223 |
| 1364048 | N/A | N/A | 16470 | 16489 | GGAAGCAGTCTACCTTCTTG | 52 | 1224 |
| 1364063 | N/A | N/A | 5302 | 5321 | TGTATACACATTATTGTCTA | 71 | 1225 |

TABLE 16-continued

Reduction of PLP1 RNA by 5-10-5 MOE gapmers with mixed PO/PS internucleoside linkages in SK-MEL-28 cells

| Compound ID | SEQ ID NO: 1 Start Site | SEQ ID NO: 1 Stop Site | SEQ ID NO: 2 Start Site | SEQ ID NO: 2 Stop Site | Sequence (5' to 3') | PLP1 (% UTC) | SEQ ID No. |
|---|---|---|---|---|---|---|---|
| 1364105 | 2686 | 2705 | 19165 | 19184 | ACAACAAAAGAACTGTAGTA | 61 | 1226 |
| 1364113 | N/A | N/A | 5905 | 5924 | TGAAGGTTGGCTCAGACAAC | 51 | 1227 |
| 1364115 | N/A | N/A | 15606 | 15625 | GGCTAATTCAAAATCCAGCA | 20 | 1228 |
| 1364147 | 2222 | 2241 | 18701 | 18720 | CCAGACATTTCTGATGCAAC | 13 | 1229 |
| 1364177 | 1509 | 1528 | 17988 | 18007 | AGGACCAAAGACATTCCTTC | 35 | 1230 |
| 1364179 | 2656 | 2675 | 19135 | 19154 | CTTCAATTAAAACCAATCAG | 53 | 1231 |
| 1364261 | 2338 | 2357 | 18817 | 18836 | CAGAATACTTGTAGAAAATC | 78 | 1232 |

TABLE 17

Reduction of PLP1 RNA by 5-10-5 MOE gapmers with mixed PO/PS internucleoside linkages in SK-MEL-28 cells

| Compound ID | SEQ ID NO: 1 Start Site | SEQ ID NO: 1 Stop Site | SEQ ID NO: 2 Start Site | SEQ ID NO: 2 Stop Site | Sequence (5' to 3') | PLP1 (% UTC) | SEQ ID No. |
|---|---|---|---|---|---|---|---|
| 1362451 | N/A | N/A | 15605 | 15624 | GCTAATTCAAAATCCAGCAA | 39 | 1233 |
| 1362466 | N/A | N/A | 8393 | 8412 | ACAAGTCTAATCAATCTGTG | 102 | 1234 |
| 1362476 | N/A | N/A | 16991 | 17010 | TCAGATAAATCACTTCACCC | 44 | 1235 |
| 1362490 | 1731 | 1750 | 18210 | 18229 | GCTTCAGTAGTCCATCGCCA | 16 | 201 |
| 1362509 | N/A | N/A | 11863 | 11882 | CCAGCATTATGCTGGGTGTT | 102 | 1236 |
| 1362531 | 2422 | 2441 | 18901 | 18920 | GTAAAATCATTTTCCATTAG | 61 | 1237 |
| 1362571 | 1818 | 1837 | 18297 | 18316 | CCCTAACGAGGTGTAAGGCC | 32 | 286 |
| 1362602 | 3035 | 3054 | 19514 | 19533 | GTGTGTTAAAATTGCAATTC | 14 | 1238 |
| 1362615 | 1421 | 1440 | 17900 | 17919 | TTTCTGATCCTCAGGAGATG | 87 | 1239 |
| 1362624 | 2879 | 2898 | 19358 | 19377 | ACGGATTACTTCACTGTCCT | 27 | 291 |
| 1362653 | 862 | 881 | 14921 | 14940 | CTGCCTATACTGGCAGAGGT | 72 | 1240 |
| 1362660 | 2917 | 2936 | 19396 | 19415 | TATTTGTTATGTTATTAAAT | 126 | 1241 |
| 1362686 | N/A | N/A | 11317 | 11336 | AGACTTTATACAAAGTCAGC | 101 | 1242 |
| 1362696 | 2221 | 2240 | 18700 | 18719 | CAGACATTTCTGATGCAACC | 28 | 1243 |
| 1362776 | 2147 | 2166 | 18626 | 18645 | AATCAAGACCTTCAAATCAC | 79 | 1244 |
| 1362794 | N/A | N/A | 5033 | 5052 | GAACACATGCTTCAAAGTGT | 45 | 1245 |
| 1362823 | 2685 | 2704 | 19164 | 19183 | CAACAAAAGAACTGTAGTAC | 57 | 1246 |
| 1362838 | 1269 | 1288 | 17748 | 17767 | GTCCAAAGAGAGACCTTAAT | 61 | 1247 |
| 1362846 | 2553 | 2572 | 19032 | 19051 | CCTGTCCTTTTTCCTGGAAG | 41 | 1248 |
| 1362875 | 3009 | 3028 | 19488 | 19507 | AGAAATGAAGGAAACACTTT | 87 | 1249 |
| 1362885 | 1958 | 1977 | 18437 | 18456 | CTGCTGCTCCTCAGGCCAGT | 31 | 1250 |
| 1362928 | 1340 | 1359 | 17819 | 17838 | AGGCATTTCCCATTTCTAGC | 18 | 1251 |
| 1362940 | 2449 | 2468 | 18928 | 18947 | CTTAACACACCAAGATAACA | 66 | 1252 |

TABLE 17-continued

Reduction of PLP1 RNA by 5-10-5 MOE gapmers with mixed PO/PS internucleoside linkages in SK-MEL-28 cells

| Compound ID | SEQ ID NO: 1 Start Site | SEQ ID NO: 1 Stop Site | SEQ ID NO: 2 Start Site | SEQ ID NO: 2 Stop Site | Sequence (5' to 3') | PLP1 (% UTC) | SEQ ID No. |
|---|---|---|---|---|---|---|---|
| 1362945 | 1645 | 1664 | 18124 | 18143 | TAGGCAGATTTGGGCAAACG | 39 | 1253 |
| 1362950 | 1508 | 1527 | 17987 | 18006 | GGACCAAAGACATTCCTTCT | 47 | 1254 |
| 1363030 | 1860 | 1879 | 18339 | 18358 | GAGAAGGGAGTGAGAAGATG | 70 | 1255 |
| 1363038 | N/A | N/A | 7655 | 7674 | CACTTATATACCACATTCAA | 79 | 1256 |
| 1363063 | N/A | N/A | 5724 | 5743 | AACTCAGTGGCTGCTCCATC | 89 | 1257 |
| 1363079 | 2066 | 2085 | 18545 | 18564 | GCCAGAGTACACAACTAATT | 23 | 1258 |
| 1363092 | 1171 | 1190 | 17650 | 17669 | TGGGAGACGCAGCATTGTAG | 57 | 1259 |
| 1363121 | 1732 | 1751 | 18211 | 18230 | GGCTTCAGTAGTCCATCGCC | 13 | 279 |
| 1363142 | N/A | N/A | 10856 | 10875 | GCAAATGTACTGGGAAGCTG | 61 | 1260 |
| 1363212 | 2736 | 2755 | 19215 | 19234 | CTTAAATATTGCTGAAACCA | 62 | 1261 |
| 1363252 | N/A | N/A | 9422 | 9441 | TGAGTCACCAGATCATAGCC | 77 | 1262 |
| 1363281 | 1231 | 1250 | 17710 | 17729 | TCTTGTTACACTCATCAAGT | 56 | 1263 |
| 1363289 | 1311 | 1330 | 17790 | 17809 | CTATGAAGCAAAATGACTAA | 84 | 1264 |
| 1363307 | N/A | N/A | 4251 | 4270 | GGACACATGACCACATCCAT | 38 | 1265 |
| 1363309 | N/A | N/A | 15889 | 15908 | TTGAGATAAAGAAGTTCCAA | 57 | 1266 |
| 1363319 | N/A | N/A | 9153 | 9172 | GCATTTAAGTTCAGCAGAAG | 71 | 1267 |
| 1363349 | N/A | N/A | 7268 | 7287 | GACAATAGTAGCCATACCTT | 76 | 1268 |
| 1363405 | 2477 | 2496 | 18956 | 18975 | GAAAATAACCTTTATGTTAA | 67 | 1269 |
| 1363428 | N/A | N/A | 6757 | 6776 | AGACTATATTTCCCCTCCCA | 78 | 1270 |
| 1363446 | N/A | N/A | 13454 | 13473 | GCATGGATCCTGCATTAACA | 93 | 1271 |
| 1363464 | 1203 | 1222 | 17682 | 17701 | GGCCAGTTGGTGGCAAAGGC | 46 | 1272 |
| 1363492 | N/A | N/A | 16466 | 16485 | GCAGTCTACCTTCTTGCCTT | 58 | 1273 |
| 1363500 | 3074 | 3093 | 19553 | 19572 | ACACTTTGTAAGATAAGTTT | 29 | 1274 |
| 1363536 | 1899 | 1918 | 18378 | 18397 | CTTGGAAACCACAGGGTTGT | 82 | 1275 |
| 1363553 | 1456 | 1475 | 17935 | 17954 | TCCATCAGTGGAAGTACCCT | 27 | 1276 |
| 1363581 | 2516 | 2535 | 18995 | 19014 | TGATGACTGGTGCATTCTGT | 34 | 1277 |
| 1363607 | N/A | N/A | 16763 | 16782 | CAGGCTATAGCAAGTCATGT | 30 | 1278 |
| 1363674 | 2369 | 2388 | 18848 | 18867 | TTCAAATTCACCAAATCTGT | 43 | 1279 |
| 1363698 | N/A | N/A | 10136 | 10155 | TGTTCTCAGAAAACATTCCA | 48 | 1280 |
| 1363703 | 2180 | 2199 | 18659 | 18678 | TGGAATACATGAAATGTGCA | 38 | 1281 |
| 1363718 | 2250 | 2269 | 18729 | 18748 | AAAACAGTCATAATCAAAGA | 70 | 1282 |
| 1363728 | N/A | N/A | 6274 | 6293 | TCTGGTTACCAGGGTAACAG | 43 | 1283 |
| 1363782 | 1391 | 1410 | 17870 | 17889 | CAATTAGAGCCTCCATTCCT | 75 | 1284 |
| 1363786 | 2313 | 2332 | 18792 | 18811 | AGATTCAACTAGCCAATTTT | 61 | 1285 |
| 1363789 | 2034 | 2053 | 18513 | 18532 | GACATGCTATCCAAAGAGTT | 48 | 1286 |
| 1363803 | 1070 | 1089 | 17549 | 17568 | AAGGACGGCAAAGTTGTAAG | 37 | 1287 |

TABLE 17-continued

Reduction of PLP1 RNA by 5-10-5 MOE gapmers with mixed PO/PS internucleoside linkages in SK-MEL-28 cells

| Compound ID | SEQ ID NO: 1 Start Site | SEQ ID NO: 1 Stop Site | SEQ ID NO: 2 Start Site | SEQ ID NO: 2 Stop Site | Sequence (5' to 3') | PLP1 (% UTC) | SEQ ID No. |
|---|---|---|---|---|---|---|---|
| 1363804 | N/A | N/A | 5901 | 5920 | GGTTGGCTCAGACAACTTCT | 44 | 1288 |
| 1363816 | 2094 | 2113 | 18573 | 18592 | TGAGCACCATTGTGAAGATA | 51 | 1289 |
| 1363857 | 1687 | 1706 | 18166 | 18185 | GGGTGAAAGATCCTTGCTTT | 52 | 1290 |
| 1363871 | N/A | N/A | 8854 | 8873 | GAGAAGTTCCTTGGCTCTCT | 56 | 1291 |
| 1363875 | 1541 | 1560 | 18020 | 18039 | AGAGAATATATTTGGCCCCT | 52 | 1292 |
| 1363889 | 2282 | 2301 | 18761 | 18780 | GTGATGCTTAATGTCCAATT | 20 | 1293 |
| 1363946 | 2655 | 2674 | 19134 | 19153 | TTCAATTAAAACCAATCAGA | 75 | 1294 |
| 1363975 | 1991 | 2010 | 18470 | 18489 | GCCATCTCAGGTTACACCAT | 25 | 1295 |
| 1364016 | N/A | N/A | 13995 | 14014 | GGGATACCAACAGATGGCTT | 43 | 1296 |
| 1364017 | N/A | N/A | 17242 | 17261 | CTAGCACTGAGTTTTCCTCA | 49 | 1297 |
| 1364020 | 1580 | 1599 | 18059 | 18078 | TAATAGAGAGACCAGAATGA | 88 | 1298 |
| 1364021 | 2602 | 2621 | 19081 | 19100 | CAGGAAAAGACTGAAATCTG | 52 | 1299 |
| 1364061 | 1757 | 1776 | 18236 | 18255 | CTGTAAGTAAGGTTGGCTGA | 38 | 1300 |
| 1364085 | N/A | N/A | 5301 | 5320 | GTATACACATTATTGTCTAA | 53 | 1301 |
| 1364116 | 2120 | 2139 | 18599 | 18618 | GACTGAATGGATAATACCCC | 20 | 211 |
| 1364118 | 2781 | 2800 | 19260 | 19279 | TTGAAAACAAGTATCAAGTG | 39 | 1302 |
| 1364124 | 2818 | 2837 | 19297 | 19316 | CTTCTATGCAGCCTGGAAGC | 62 | 1303 |
| 1364165 | 2337 | 2356 | 18816 | 18835 | AGAATACTTGTAGAAAATCC | 70 | 1304 |
| 1364166 | N/A | N/A | 12527 | 12546 | CAGTAGGTAGCTCATGCCAC | 90 | 1305 |
| 1364230 | 2396 | 2415 | 18875 | 18894 | AGAACGATCAGATTACTCAA | 36 | 1306 |

TABLE 18

Reduction of PLP1 RNA by 5-10-5 MOE gapmers with mixed PO/PS internucleoside linkages in SK-MEL-28 cells

| Compound ID | SEQ ID NO: 1 Start Site | SEQ ID NO: 1 Stop Site | SEQ ID NO: 2 Start Site | SEQ ID NO: 2 Stop Site | Sequence (5' to 3') | PLP1 (% UTC) | SEQ ID No. |
|---|---|---|---|---|---|---|---|
| 1362454 | 2684 | 2703 | 19163 | 19182 | AACAAAAGAACTGTAGTACA | 52 | 1307 |
| 1362473 | 2179 | 2198 | 18658 | 18677 | GGAATACATGAAATGTGCAT | 8 | 1308 |
| 1362490 | 1731 | 1750 | 18210 | 18229 | GCTTCAGTAGTCCATCGCCA | 15 | 201 |
| 1362503 | N/A | N/A | 10840 | 10859 | GCTGCTATTTTTGAATAAGC | 24 | 1309 |
| 1362517 | 1168 | 1187 | 17647 | 17666 | GAGACGCAGCATTGTAGGCT | 9 | 276 |
| 1362543 | N/A | N/A | 5898 | 5917 | TGGCTCAGACAACTTCTAAA | 36 | 1310 |
| 1362551 | N/A | N/A | 17239 | 17258 | GCACTGAGTTTTCCTCAGGG | 23 | 1311 |
| 1362593 | 1418 | 1437 | 17897 | 17916 | CTGATCCTCAGGAGATGCTT | 26 | 1312 |
| 1362609 | 2735 | 2754 | 19214 | 19233 | TTAAATATTGCTGAAACCAC | 43 | 1313 |

TABLE 18-continued

Reduction of PLP1 RNA by 5-10-5 MOE gapmers with mixed PO/PS internucleoside linkages in SK-MEL-28 cells

| Compound ID | SEQ ID NO: 1 Start Site | SEQ ID NO: 1 Stop Site | SEQ ID NO: 2 Start Site | SEQ ID NO: 2 Stop Site | Sequence (5' to 3') | PLP1 (% UTC) | SEQ ID No. |
|---|---|---|---|---|---|---|---|
| 1362610 | 2312 | 2331 | 18791 | 18810 | GATTCAACTAGCCAATTTTT | 48 | 1314 |
| 1362656 | N/A | N/A | 9142 | 9161 | CAGCAGAAGTGAAGAATCTC | 54 | 1315 |
| 1362657 | N/A | N/A | 6756 | 6775 | GACTATATTTCCCCTCCCAC | 81 | 1316 |
| 1362662 | N/A | N/A | 5298 | 5317 | TACACATTATTGTCTAATAG | 66 | 1317 |
| 1362697 | 1817 | 1836 | 18296 | 18315 | CCTAACGAGGTGTAAGGCCA | 23 | 1318 |
| 1362709 | 1507 | 1526 | 17986 | 18005 | GACCAAAGACATTCCTTCTC | 37 | 1319 |
| 1362724 | 1955 | 1974 | 18434 | 18453 | CTGCTCCTCAGGCCAGTCTG | 17 | 1320 |
| 1362733 | 2421 | 2440 | 18900 | 18919 | TAAAATCATTTTCCATTAGC | 54 | 1321 |
| 1362752 | 2654 | 2673 | 19133 | 19152 | TCAATTAAAACCAATCAGAC | 53 | 1322 |
| 1362774 | 1644 | 1663 | 18123 | 18142 | AGGCAGATTTGGGCAAACGC | 15 | 1323 |
| 1362795 | 2033 | 2052 | 18512 | 18531 | ACATGCTATCCAAAGAGTTA | 47 | 1324 |
| 1362797 | 1310 | 1329 | 17789 | 17808 | TATGAAGCAAAATGACTAAA | 82 | 1325 |
| 1362805 | 2515 | 2534 | 18994 | 19013 | GATGACTGGTGCATTCTGTT | 16 | 212 |
| 1362819 | 3073 | 3092 | 19552 | 19571 | CACTTTGTAAGATAAGTTTC | 28 | 1326 |
| 1362873 | 1390 | 1409 | 17869 | 17888 | AATTAGAGCCTCCATTCCTT | 49 | 1327 |
| 1362890 | 2448 | 2467 | 18927 | 18946 | TTAACACACCAAGATAACAT | 56 | 1328 |
| 1362897 | 1268 | 1287 | 17747 | 17766 | TCCAAAGAGAGACCTTAATC | 72 | 1329 |
| 1362905 | N/A | N/A | 10135 | 10154 | GTTCTCAGAAAACATTCCAG | 39 | 1330 |
| 1362974 | N/A | N/A | 13446 | 13465 | CCTGCATTAACAGGTAGACA | 83 | 1331 |
| 1363045 | 2915 | 2934 | 19394 | 19413 | TTTGTTATGTTATTAAATCA | 80 | 1332 |
| 1363049 | N/A | N/A | 16458 | 16477 | CCTTCTTGCCTTTCAGAATA | 60 | 1333 |
| 1363107 | N/A | N/A | 11316 | 11335 | GACTTTATACAAAGTCAGCA | 71 | 1334 |
| 1363117 | N/A | N/A | 4961 | 4980 | ATTGCAAATTGATCTCTGTG | 37 | 1335 |
| 1363118 | 2065 | 2084 | 18544 | 18563 | CCAGAGTACACAACTAATTA | 19 | 1336 |
| 1363121 | 1732 | 1751 | 18211 | 18230 | GGCTTCAGTAGTCCATCGCC | 13 | 279 |
| 1363130 | 1756 | 1775 | 18235 | 18254 | TGTAAGTAAGGTTGGCTGAG | 52 | 1337 |
| 1363175 | 1455 | 1474 | 17934 | 17953 | CCATCAGTGGAAGTACCCTT | 26 | 1338 |
| 1363198 | 1202 | 1221 | 17681 | 17700 | GCCAGTTGGTGGCAAAGGCA | 37 | 1339 |
| 1363205 | N/A | N/A | 16761 | 16780 | GGCTATAGCAAGTCATGTTT | 30 | 1340 |
| 1363268 | 3034 | 3053 | 19513 | 19532 | TGTGTTAAAATTGCAATTCT | 27 | 1341 |
| 1363329 | N/A | N/A | 4250 | 4269 | GACACATGACCACATCCATC | 52 | 1342 |
| 1363374 | 2091 | 2110 | 18570 | 18589 | GCACCATTGTGAAGATATGA | 21 | 1343 |
| 1363399 | 1230 | 1249 | 17709 | 17728 | CTTGTTACACTCATCAAGTA | 44 | 1344 |
| 1363404 | 804 | 823 | 14863 | 14882 | TGTTGAAGTAAATGTACACA | 65 | 1345 |
| 1363407 | 1068 | 1087 | 17547 | 17566 | GGACGGCAAAGTTGTAAGTG | 26 | 1346 |
| 1363414 | 2601 | 2620 | 19080 | 19099 | AGGAAAAGACTGAAATCTGG | 34 | 1347 |

TABLE 18-continued

Reduction of PLP1 RNA by 5-10-5 MOE gapmers with mixed PO/PS internucleoside linkages in SK-MEL-28 cells

| Compound ID | SEQ ID NO: 1 Start Site | SEQ ID NO: 1 Stop Site | SEQ ID NO: 2 Start Site | SEQ ID NO: 2 Stop Site | Sequence (5' to 3') | PLP1 (% UTC) | SEQ ID No. |
|---|---|---|---|---|---|---|---|
| 1363435 | 1859 | 1878 | 18338 | 18357 | AGAAGGGAGTGAGAAGATGC | 45 | 1348 |
| 1363442 | 1897 | 1916 | 18376 | 18395 | TGGAAACCACAGGGTTGTCA | 34 | 1349 |
| 1363458 | 2249 | 2268 | 18728 | 18747 | AAACAGTCATAATCAAAGAA | 66 | 1350 |
| 1363470 | 2779 | 2798 | 19258 | 19277 | GAAAACAAGTATCAAGTGTC | 32 | 1351 |
| 1363484 | 3008 | 3027 | 19487 | 19506 | GAAATGAAGGAAACACTTTC | 70 | 1352 |
| 1363499 | 2877 | 2896 | 19356 | 19375 | GGATTACTTCACTGTCCTTT | 19 | 1353 |
| 1363533 | 1990 | 2009 | 18469 | 18488 | CCATCTCAGGTTACACCATT | 25 | 1354 |
| 1363549 | N/A | N/A | 15852 | 15871 | AAAACCTATGAATGCCTCTG | 60 | 1355 |
| 1363564 | N/A | N/A | 12423 | 12442 | TTGGCTTTCAGCATGTGAGA | 46 | 1356 |
| 1363585 | 1338 | 1357 | 17817 | 17836 | GCATTTCCCATTTCTAGCAG | 35 | 1357 |
| 1363591 | 2281 | 2300 | 18760 | 18779 | TGATGCTTAATGTCCAATTT | 14 | 1358 |
| 1363662 | N/A | N/A | 7267 | 7286 | ACAATAGTAGCCATACCTTG | 80 | 1359 |
| 1363673 | 2119 | 2138 | 18598 | 18617 | ACTGAATGGATAATACCCCA | 18 | 1360 |
| 1363683 | 2336 | 2355 | 18815 | 18834 | GAATACTTGTAGAAAATCCC | 28 | 1361 |
| 1363750 | 1685 | 1704 | 18164 | 18183 | GTGAAAGATCCTTGCTTTGA | 82 | 1362 |
| 1363765 | 2552 | 2571 | 19031 | 19050 | CTGTCCTTTTTCCTGGAAGC | 25 | 1363 |
| 1363778 | 2146 | 2165 | 18625 | 18644 | ATCAAGACCTTCAAATCACC | 51 | 1364 |
| 1363788 | 2395 | 2414 | 18874 | 18893 | GAACGATCAGATTACTCAAA | 21 | 1365 |
| 1363819 | N/A | N/A | 8391 | 8410 | AAGTCTAATCAATCTGTGAT | 70 | 1366 |
| 1363822 | 1540 | 1559 | 18019 | 18038 | GAGAATATATTTGGCCCCTA | 47 | 1367 |
| 1363912 | N/A | N/A | 16985 | 17004 | AAATCACTTCACCCTTCAGT | 102 | 1368 |
| 1363916 | 2475 | 2494 | 18954 | 18973 | AAATAACCTTTATGTTAAAC | 81 | 1369 |
| 1363943 | N/A | N/A | 13994 | 14013 | GGATACCAACAGATGGCTTA | 53 | 1370 |
| 1363990 | N/A | N/A | 15538 | 15557 | ATGGTATTAGCTACTCCCTT | 26 | 1371 |
| 1364069 | 2368 | 2387 | 18847 | 18866 | TCAAATTCACCAAATCTGTT | 30 | 1372 |
| 1364107 | 2219 | 2238 | 18698 | 18717 | GACATTTCTGATGCAACCCC | 15 | 1373 |
| 1364183 | N/A | N/A | 5709 | 5728 | CCATCATATGTACCTGGCCC | 48 | 1374 |
| 1364216 | 2816 | 2835 | 19295 | 19314 | TCTATGCAGCCTGGAAGCTT | 35 | 1375 |
| 1364220 | N/A | N/A | 6271 | 6290 | GGTTACCAGGGTAACAGCCA | 39 | 1376 |
| 1364228 | N/A | N/A | 11799 | 11818 | GAGTCTTTAATTTCCTGAGG | 50 | 1377 |
| 1364238 | N/A | N/A | 9418 | 9437 | TCACCAGATCATAGCCTTTC | 43 | 1378 |
| 1364250 | N/A | N/A | 7654 | 7673 | ACTTATATACCACATTCAAG | 88 | 1379 |
| 1364256 | 1579 | 1598 | 18058 | 18077 | AATAGAGAGACCAGAATGAA | 85 | 1380 |
| 1364271 | N/A | N/A | 8838 | 8857 | CTCTCAAGAGACATTCTCAC | 70 | 1381 |

TABLE 19

Reduction of PLP1 RNA by 5-10-5 MOE gapmers with mixed PO/PS internucleoside linkages in SK-MEL-28 cells

| Compound ID | SEQ ID NO: 1 Start Site | SEQ ID NO: 1 Stop Site | SEQ ID NO: 2 Start Site | SEQ ID NO: 2 Stop Site | Sequence (5' to 3') | PLP1 (% UTC) | SEQ ID No. |
|---|---|---|---|---|---|---|---|
| 1362435 | 1578 | 1597 | 18057 | 18076 | ATAGAGAGACCAGAATGAAT | 81 | 1382 |
| 1362461 | 2683 | 2702 | 19162 | 19181 | ACAAAAGAACTGTAGTACAA | 36 | 1383 |
| 1362474 | N/A | N/A | 9141 | 9160 | AGCAGAAGTGAAGAATCTCA | 55 | 1384 |
| 1362478 | N/A | N/A | 16950 | 16969 | TCTGCACAATGAGCACACTA | 41 | 1385 |
| 1362490 | 1731 | 1750 | 18210 | 18229 | GCTTCAGTAGTCCATCGCCA | 15 | 201 |
| 1362493 | N/A | N/A | 5264 | 5283 | ATTTACAGTTGTTATAGATC | 44 | 1386 |
| 1362512 | 2117 | 2136 | 18596 | 18615 | TGAATGGATAATACCCCATG | 33 | 1387 |
| 1362532 | 1896 | 1915 | 18375 | 18394 | GGAAACCACAGGGTTGTCAT | 26 | 1388 |
| 1362541 | N/A | N/A | 4131 | 4150 | ATCTAACTGAATGTTAAGGA | 41 | 1389 |
| 1362544 | 1755 | 1774 | 18234 | 18253 | GTAAGTAAGGTTGGCTGAGT | 32 | 1390 |
| 1362553 | 3072 | 3091 | 19551 | 19570 | ACTTTGTAAGATAAGTTTCT | 39 | 1391 |
| 1362555 | N/A | N/A | 10134 | 10153 | TTCTCAGAAAACATTCCAGA | 62 | 1392 |
| 1362562 | 2734 | 2753 | 19213 | 19232 | TAAATATTGCTGAAACCACT | 36 | 1393 |
| 1362583 | N/A | N/A | 7260 | 7279 | TAGCCATACCTTGTTCCTCA | 39 | 1394 |
| 1362619 | 2064 | 2083 | 18543 | 18562 | CAGAGTACACAACTAATTAA | 45 | 1395 |
| 1362640 | 803 | 822 | 14862 | 14881 | GTTGAAGTAAATGTACACAG | 62 | 1396 |
| 1362655 | 1228 | 1247 | 17707 | 17726 | TGTTACACTCATCAAGTAAG | 32 | 1397 |
| 1362689 | 2280 | 2299 | 18759 | 18778 | GATGCTTAATGTCCAATTTT | 17 | 1398 |
| 1362702 | N/A | N/A | 4959 | 4978 | TGCAAATTGATCTCTGTGGA | 29 | 1399 |
| 1362716 | 2367 | 2386 | 18846 | 18865 | CAAATTCACCAAATCTGTTT | 56 | 1400 |
| 1362732 | N/A | N/A | 8835 | 8854 | TCAAGAGACATTCTCACATT | 82 | 1401 |
| 1362736 | 2032 | 2051 | 18511 | 18530 | CATGCTATCCAAAGAGTTAT | 41 | 1402 |
| 1362742 | N/A | N/A | 16690 | 16709 | AACCGTAATTTATGACTGCA | 26 | 1403 |
| 1362789 | 2600 | 2619 | 19079 | 19098 | GGAAAAGACTGAAATCTGGG | 24 | 1404 |
| 1362800 | 2653 | 2672 | 19132 | 19151 | CAATTAAAACCAATCAGACT | 74 | 1405 |
| 1362811 | 1506 | 1525 | 17985 | 18004 | ACCAAAGACATTCCTTCTCT | 45 | 1406 |
| 1362832 | 2420 | 2439 | 18899 | 18918 | AAAATCATTTTCCATTAGCT | 32 | 1407 |
| 1362883 | 1684 | 1703 | 18163 | 18182 | TGAAAGATCCTTGCTTTGAC | 88 | 1408 |
| 1362910 | N/A | N/A | 13993 | 14012 | GATACCAACAGATGGCTTAG | 52 | 1409 |
| 1362930 | 2311 | 2330 | 18790 | 18809 | ATTCAACTAGCCAATTTTTA | 66 | 1410 |
| 1362944 | N/A | N/A | 5706 | 5725 | TCATATGTACCTGGCCCAAG | 83 | 1411 |
| 1362958 | N/A | N/A | 9417 | 9436 | CACCAGATCATAGCCTTTCT | 37 | 1412 |
| 1362977 | 1816 | 1835 | 18295 | 18314 | CTAACGAGGTGTAAGGCCAG | 44 | 1413 |
| 1362981 | N/A | N/A | 16455 | 16474 | TCTTGCCTTTCAGAATAGCT | 37 | 1414 |
| 1362991 | N/A | N/A | 7650 | 7669 | ATATACCACATTCAAGTGCT | 69 | 1415 |
| 1362992 | N/A | N/A | 6270 | 6289 | GTTACCAGGGTAACAGCCAC | 41 | 1416 |

TABLE 19-continued

Reduction of PLP1 RNA by 5-10-5 MOE gapmers with mixed PO/PS internucleoside linkages in SK-MEL-28 cells

| Compound ID | SEQ ID NO: 1 Start Site | SEQ ID NO: 1 Stop Site | SEQ ID NO: 2 Start Site | SEQ ID NO: 2 Stop Site | Sequence (5' to 3') | PLP1 (% UTC) | SEQ ID No. |
|---|---|---|---|---|---|---|---|
| 1363040 | 2335 | 2354 | 18814 | 18833 | AATACTTGTAGAAAATCCCA | 30 | 1417 |
| 1363042 | N/A | N/A | 8362 | 8381 | TCCAACTTTAAGCCCTTCTC | 51 | 1418 |
| 1363078 | 1538 | 1557 | 18017 | 18036 | GAATATATTTGGCCCCTATA | 91 | 1419 |
| 1363085 | 1267 | 1286 | 17746 | 17765 | CCAAAGAGAGACCTTAATCA | 57 | 1420 |
| 1363096 | 2172 | 2191 | 18651 | 18670 | ATGAAATGTGCATCATTCTA | 44 | 1421 |
| 1363121 | 1732 | 1751 | 18211 | 18230 | GGCTTCAGTAGTCCATCGCC | 17 | 279 |
| 1363128 | 1989 | 2008 | 18468 | 18487 | CATCTCAGGTTACACCATTA | 37 | 1422 |
| 1363191 | 1628 | 1647 | 18107 | 18126 | ACGCTCTTATTGTTTTTCTG | 15 | 1423 |
| 1363208 | 2248 | 2267 | 18727 | 18746 | AACAGTCATAATCAAAGAAT | 60 | 1424 |
| 1363228 | 3007 | 3026 | 19486 | 19505 | AAATGAAGGAAACACTTTCA | 61 | 1425 |
| 1363301 | 1417 | 1436 | 17896 | 17915 | TGATCCTCAGGAGATGCTTG | 37 | 1426 |
| 1363313 | N/A | N/A | 6755 | 6774 | ACTATATTTCCCCTCCCACC | 89 | 1427 |
| 1363370 | 1309 | 1328 | 17788 | 17807 | ATGAAGCAAAATGACTAAAA | 70 | 1428 |
| 1363423 | 1067 | 1086 | 17546 | 17565 | GACGGCAAAGTTGTAAGTGG | 34 | 1429 |
| 1363433 | 1200 | 1219 | 17679 | 17698 | CAGTTGGTGGCAAAGGCAAA | 42 | 1430 |
| 1363544 | 1167 | 1186 | 17646 | 17665 | AGACGCAGCATTGTAGGCTG | 13 | 1431 |
| 1363573 | N/A | N/A | 13445 | 13464 | CTGCATTAACAGGTAGACAA | 83 | 1432 |
| 1363576 | 1337 | 1356 | 17816 | 17835 | CATTTCCCATTTCTAGCAGG | 54 | 1433 |
| 1363643 | 1454 | 1473 | 17933 | 17952 | CATCAGTGGAAGTACCCTTT | 49 | 1434 |
| 1363678 | 3033 | 3052 | 19512 | 19531 | GTGTTAAAATTGCAATTCTA | 19 | 1435 |
| 1363684 | N/A | N/A | 15510 | 15529 | ACCCAAATAACCCACTCACC | 91† | 1436 |
| 1363692 | 1858 | 1877 | 18337 | 18356 | GAAGGGAGTGAGAAGATGCT | 42 | 1437 |
| 1363697 | 2218 | 2237 | 18697 | 18716 | ACATTTCTGATGCAACCCCA | 34 | 1438 |
| 1363705 | 2393 | 2412 | 18872 | 18891 | ACGATCAGATTACTCAAATT | 24 | 1439 |
| 1363763 | 2815 | 2834 | 19294 | 19313 | CTATGCAGCCTGGAAGCTTA | 28 | 1440 |
| 1363824 | N/A | N/A | 5897 | 5916 | GGCTCAGACAACTTCTAAAG | 39 | 1441 |
| 1363833 | N/A | N/A | 15851 | 15870 | AAACCTATGAATGCCTCTGT | 69 | 1442 |
| 1363834 | 2090 | 2109 | 18569 | 18588 | CACCATTGTGAAGATATGAC | 23 | 1443 |
| 1363868 | N/A | N/A | 10837 | 10856 | GCTATTTTTGAATAAGCAGG | 41 | 1444 |
| 1363949 | 2145 | 2164 | 18624 | 18643 | TCAAGACCTTCAAATCACCT | 49 | 1445 |
| 1363984 | 2513 | 2532 | 18992 | 19011 | TGACTGGTGCATTCTGTTAT | 30 | 1446 |
| 1363988 | 2474 | 2493 | 18953 | 18972 | AATAACCTTTATGTTAAACC | 54 | 1447 |
| 1364051 | N/A | N/A | 17220 | 17239 | GAAGTGAACAATATTTGGGC | 57 | 1448 |
| 1364055 | N/A | N/A | 11315 | 11334 | ACTTTATACAAAGTCAGCAA | 67 | 1449 |
| 1364090 | N/A | N/A | 12420 | 12439 | GCTTTCAGCATGTGAGATTG | 42 | 1450 |
| 1364094 | 1383 | 1402 | 17862 | 17881 | GCCTCCATTCCTTTGTGACT | 41 | 1451 |

TABLE 19-continued

Reduction of PLP1 RNA by 5-10-5 MOE gapmers with mixed PO/PS internucleoside linkages in SK-MEL-28 cells

| Compound ID | SEQ ID NO: 1 Start Site | SEQ ID NO: 1 Stop Site | SEQ ID NO: 2 Start Site | SEQ ID NO: 2 Stop Site | Sequence (5' to 3') | PLP1 (% UTC) | SEQ ID No. |
|---|---|---|---|---|---|---|---|
| 1364095 | 2778 | 2797 | 19257 | 19276 | AAAACAAGTATCAAGTGTCT | 31 | 1452 |
| 1364197 | 1951 | 1970 | 18430 | 18449 | TCCTCAGGCCAGTCTGTTCT | 28 | 1453 |
| 1364198 | N/A | N/A | 11796 | 11815 | TCTTTAATTTCCTGAGGAAG | 92 | 1454 |
| 1364201 | 2549 | 2568 | 19028 | 19047 | TCCTTTTTCCTGGAAGCTTA | 21 | 1455 |
| 1364239 | 2447 | 2466 | 18926 | 18945 | TAACACACCAAGATAACATT | 44 | 1456 |
| 1364257 | 2876 | 2895 | 19355 | 19374 | GATTACTTCACTGTCCTTTA | 17 | 1457 |
| 1364258 | 2913 | 2932 | 19392 | 19411 | TGTTATGTTATTAAATCAAA | 72 | 1458 |

TABLE 20

Reduction of PLP1 RNA by 5-10-5 MOE gapmers with mixed PO/PS internucleoside linkages in SK-MEL-28 cells

| Compound ID | SEQ ID NO: 1 Start Site | SEQ ID NO: 1 Stop Site | SEQ ID NO: 2 Start Site | SEQ ID NO: 2 Stop Site | Sequence (5' to 3') | PLP1 (% UTC) | SEQ ID No. |
|---|---|---|---|---|---|---|---|
| 1362436 | 2912 | 2931 | 19391 | 19410 | GTTATGTTATTAAATCAAAA | 73 | 1459 |
| 1362487 | N/A | N/A | 11309 | 11328 | TACAAAGTCAGCAAAGCATG | 110 | 1460 |
| 1362490 | 1731 | 1750 | 18210 | 18229 | GCTTCAGTAGTCCATCGCCA | 21 | 201 |
| 1362506 | 802 | 821 | 14861 | 14880 | TTGAAGTAAATGTACACAGG | 97 | 1461 |
| 1362542 | 2365 | 2384 | 18844 | 18863 | AATTCACCAAATCTGTTTCT | 57 | 1462 |
| 1362575 | 2276 | 2295 | 18755 | 18774 | CTTAATGTCCAATTTTCCTA | 35 | 1463 |
| 1362581 | N/A | N/A | 13443 | 13462 | GCATTAACAGGTAGACAAAC | 103 | 1464 |
| 1362618 | 1988 | 2007 | 18467 | 18486 | ATCTCAGGTTACACCATTAG | 60 | 1465 |
| 1362639 | 3071 | 3090 | 19550 | 19569 | CTTTGTAAGATAAGTTTCTA | 56 | 1466 |
| 1362688 | N/A | N/A | 4924 | 4943 | GCTACATTTGATAGGGAATA | 26 | 1467 |
| 1362705 | 2419 | 2438 | 18898 | 18917 | AAATCATTTTCCATTAGCTA | 48 | 1468 |
| 1362781 | N/A | N/A | 5888 | 5907 | AACTTCTAAAGTTCCTTCCA | 57 | 1469 |
| 1362783 | N/A | N/A | 6729 | 6748 | CCAGGGTTGAGGTTGTTATT | 74 | 1470 |
| 1362859 | 2652 | 2671 | 19131 | 19150 | AATTAAAACCAATCAGACTT | 75 | 1471 |
| 1362867 | N/A | N/A | 4094 | 4113 | GTGCCAAAACACGACTCATT | 28 | 1472 |
| 1362868 | N/A | N/A | 8361 | 8380 | CCAACTTTAAGCCCTTCTCA | 67 | 1473 |
| 1362888 | 2116 | 2135 | 18595 | 18614 | GAATGGATAATACCCCATGA | 34 | 1474 |
| 1362914 | 2446 | 2465 | 18925 | 18944 | AACACACCAAGATAACATTG | 34 | 1475 |
| 1362926 | 1626 | 1645 | 18105 | 18124 | GCTCTTATTGTTTTTCTGAC | 18 | 1476 |
| 1362948 | 1227 | 1246 | 17706 | 17725 | GTTACACTCATCAAGTAAGA | 19 | 1477 |
| 1362968 | 2392 | 2411 | 18871 | 18890 | CGATCAGATTACTCAAATTG | 47 | 1478 |
| 1363041 | N/A | N/A | 11765 | 11784 | TAGACCTAATATTTTCAACT | 69 | 1479 |
| 1363062 | 3032 | 3051 | 19511 | 19530 | TGTTAAAATTGCAATTCTAT | 49 | 1480 |

TABLE 20-continued

Reduction of PLP1 RNA by 5-10-5 MOE gapmers with mixed PO/PS internucleoside linkages in SK-MEL-28 cells

| Compound ID | SEQ ID NO: 1 Start Site | SEQ ID NO: 1 Stop Site | SEQ ID NO: 2 Start Site | SEQ ID NO: 2 Stop Site | Sequence (5' to 3') | PLP1 (% UTC) | SEQ ID No. |
|---|---|---|---|---|---|---|---|
| 1363099 | N/A | N/A | 12413 | 12432 | GCATGTGAGATTGACCCAGA | 54 | 1481 |
| 1363121 | 1732 | 1751 | 18211 | 18230 | GGCTTCAGTAGTCCATCGCC | 11 | 279 |
| 1363122 | N/A | N/A | 13990 | 14009 | ACCAACAGATGGCTTAGAAA | 66 | 1482 |
| 1363150 | N/A | N/A | 16688 | 16707 | CCGTAATTTATGACTGCAAA | 31 | 1483 |
| 1363155 | N/A | N/A | 10123 | 10142 | CATTCCAGAAATTGATCTTC | 60 | 1484 |
| 1363190 | 2777 | 2796 | 19256 | 19275 | AAACAAGTATCAAGTGTCTT | 27 | 1485 |
| 1363202 | N/A | N/A | 8826 | 8845 | ATTCTCACATTTCCAGTCTA | 87 | 1486 |
| 1363318 | 2247 | 2266 | 18726 | 18745 | ACAGTCATAATCAAAGAATT | 45 | 1487 |
| 1363358 | 1266 | 1285 | 17745 | 17764 | CAAAGAGAGACCTTAATCAC | 70 | 1488 |
| 1363385 | 2334 | 2353 | 18813 | 18832 | ATACTTGTAGAAAATCCCAA | 34 | 1489 |
| 1363387 | 1537 | 1556 | 18016 | 18035 | AATATATTTGGCCCCTATAG | 88 | 1490 |
| 1363390 | 1451 | 1470 | 17930 | 17949 | CAGTGGAAGTACCCTTTGAG | 53 | 1491 |
| 1363412 | 1308 | 1327 | 17787 | 17806 | TGAAGCAAAATGACTAAAAG | 102 | 1492 |
| 1363498 | 2310 | 2329 | 18789 | 18808 | TTCAACTAGCCAATTTTTAA | 69 | 1493 |
| 1363514 | 2473 | 2492 | 18952 | 18971 | ATAACCTTTATGTTAAACCT | 44 | 1494 |
| 1363520 | 1683 | 1702 | 18162 | 18181 | GAAAGATCCTTGCTTTGACC | 65 | 1495 |
| 1363530 | 2546 | 2565 | 19025 | 19044 | TTTTTCCTGGAAGCTTACCA | 41 | 1496 |
| 1363532 | 1334 | 1353 | 17813 | 17832 | TTCCCATTTCTAGCAGGAAC | 48 | 1497 |
| 1363541 | 1196 | 1215 | 17675 | 17694 | TGGTGGCAAAGGCAAAGAGT | 47 | 1498 |
| 1363557 | 1382 | 1401 | 17861 | 17880 | CCTCCATTCCTTTGTGACTT | 21 | 1499 |
| 1363596 | N/A | N/A | 17217 | 17236 | GTGAACAATATTTGGGCTTT | 23 | 1500 |
| 1363599 | 2731 | 2750 | 19210 | 19229 | ATATTGCTGAAACCACTTTG | 53 | 1501 |
| 1363602 | 2812 | 2831 | 19291 | 19310 | TGCAGCCTGGAAGCTTATCT | 18 | 1502 |
| 1363621 | 3006 | 3025 | 19485 | 19504 | AATGAAGGAAACACTTTCAG | 69 | 1503 |
| 1363628 | 2872 | 2891 | 19351 | 19370 | ACTTCACTGTCCTTTATCTT | 24 | 1504 |
| 1363653 | 2030 | 2049 | 18509 | 18528 | TGCTATCCAAAGAGTTATCT | 30 | 1505 |
| 1363671 | 1895 | 1914 | 18374 | 18393 | GAAACCACAGGGTTGTCATG | 38 | 1506 |
| 1363700 | 1754 | 1773 | 18233 | 18252 | TAAGTAAGGTTGGCTGAGTT | 63 | 1507 |
| 1363725 | 1164 | 1183 | 17643 | 17662 | CGCAGCATTGTAGGCTGTGT | 52 | 120 |
| 1363741 | N/A | N/A | 16948 | 16967 | TGCACAATGAGCACACTACA | 55 | 1508 |
| 1363757 | N/A | N/A | 15509 | 15528 | CCCAAATAACCCACTCACCT | 75† | 1509 |
| 1363773 | 2503 | 2522 | 18982 | 19001 | ATTCTGTTATGTGATCTATA | 27 | 1510 |
| 1363785 | N/A | N/A | 16449 | 16468 | CTTTCAGAATAGCTGTACCC | 82 | 1511 |
| 1363787 | N/A | N/A | 7649 | 7668 | TATACCACATTCAAGTGCTG | 84 | 1512 |
| 1363790 | 1815 | 1834 | 18294 | 18313 | TAACGAGGTGTAAGGCCAGA | 55 | 1513 |
| 1363796 | 2063 | 2082 | 18542 | 18561 | AGAGTACACAACTAATTAAC | 47 | 1514 |

TABLE 20-continued

Reduction of PLP1 RNA by 5-10-5 MOE gapmers with mixed PO/PS internucleoside linkages in SK-MEL-28 cells

| Compound ID | SEQ ID NO: 1 Start Site | SEQ ID NO: 1 Stop Site | SEQ ID NO: 2 Start Site | SEQ ID NO: 2 Stop Site | Sequence (5' to 3') | PLP1 (% UTC) | SEQ ID No. |
|---|---|---|---|---|---|---|---|
| 1363820 | 2682 | 2701 | 19161 | 19180 | CAAAAGAACTGTAGTACAAA | 85 | 1515 |
| 1363837 | N/A | N/A | 7253 | 7272 | ACCTTGTTCCTCAGGTCAGT | 49 | 1516 |
| 1363844 | N/A | N/A | 15848 | 15867 | CCTATGAATGCCTCTGTGCA | 67 | 1517 |
| 1363878 | 1066 | 1085 | 17545 | 17564 | ACGGCAAAGTTGTAAGTGGC | 27 | 1518 |
| 1363905 | N/A | N/A | 6262 | 6281 | GGTAACAGCCACTGTTCTCA | 64 | 1519 |
| 1363913 | 1857 | 1876 | 18336 | 18355 | AAGGGAGTGAGAAGATGCTG | 51 | 1520 |
| 1363919 | 2599 | 2618 | 19078 | 19097 | GAAAAGACTGAAATCTGGGA | 44 | 1521 |
| 1363924 | N/A | N/A | 5263 | 5282 | TTTACAGTTGTTATAGATCT | 53 | 1522 |
| 1363954 | 1505 | 1524 | 17984 | 18003 | CCAAAGACATTCCTTCTCTG | 44 | 1523 |
| 1363970 | N/A | N/A | 10836 | 10855 | CTATTTTTGAATAAGCAGGT | 51 | 1524 |
| 1363995 | 2089 | 2108 | 18568 | 18587 | ACCATTGTGAAGATATGACA | 28 | 1525 |
| 1364005 | N/A | N/A | 5664 | 5683 | GGACCCAATGTGCATCCTCA | 60 | 1526 |
| 1364026 | 2171 | 2190 | 18650 | 18669 | TGAAATGTGCATCATTCTAA | 63 | 1527 |
| 1364074 | N/A | N/A | 9397 | 9416 | TTTTACATCCATTTTTCCTC | 58 | 1528 |
| 1364125 | 1947 | 1966 | 18426 | 18445 | CAGGCCAGTCTGTTCTCATG | 14 | 1529 |
| 1364164 | 1415 | 1434 | 17894 | 17913 | ATCCTCAGGAGATGCTTGAA | 59 | 1530 |
| 1364207 | 2212 | 2231 | 18691 | 18710 | CTGATGCAACCCCAAATAAG | 49 | 1531 |
| 1364215 | 1577 | 1596 | 18056 | 18075 | TAGAGAGACCAGAATGAATT | 67 | 1532 |
| 1364233 | N/A | N/A | 9140 | 9159 | GCAGAAGTGAAGAATCTCAG | 62 | 1533 |
| 1364253 | 2144 | 2163 | 18623 | 18642 | CAAGACCTTCAAATCACCTA | 26 | 1534 |

TABLE 21

Reduction of PLP1 RNA by 5-10-5 MOE gapmers with mixed PO/PS internucleoside linkages in SK-MEL-28 cells

| Compound ID | SEQ ID NO: 1 Start Site | SEQ ID NO: 1 Stop Site | SEQ ID NO: 2 Start Site | SEQ ID NO: 2 Stop Site | Sequence (5' to 3') | PLP1 (% UTC) | SEQ ID No. |
|---|---|---|---|---|---|---|---|
| 1362456 | N/A | N/A | 7246 | 7265 | TCCTCAGGTCAGTCTCCCAC | 54 | 1535 |
| 1362459 | 1449 | 1468 | 17928 | 17947 | GTGGAAGTACCCTTTGAGAA | 43 | 1536 |
| 1362489 | 2115 | 2134 | 18594 | 18613 | AATGGATAATACCCCATGAA | 55 | 1537 |
| 1362490 | 1731 | 1750 | 18210 | 18229 | GCTTCAGTAGTCCATCGCCA | 29 | 201 |
| 1362519 | 1942 | 1961 | 18421 | 18440 | CAGTCTGTTCTCATGTAAGC | 20 | 1538 |
| 1362529 | 2143 | 2162 | 18622 | 18641 | AAGACCTTCAAATCACCTAC | 41 | 1539 |
| 1362536 | N/A | N/A | 5887 | 5906 | ACTTCTAAAGTTCCTTCCAA | 96 | 1540 |
| 1362570 | N/A | N/A | 6719 | 6738 | GGTTGTTATTACTCAGATCG | 69 | 1541 |
| 1362591 | 1160 | 1179 | 17639 | 17658 | GCATTGTAGGCTGTGTGGTT | 18 | 1542 |

TABLE 21-continued

Reduction of PLP1 RNA by 5-10-5 MOE gapmers with mixed PO/PS internucleoside linkages in SK-MEL-28 cells

| Compound ID | SEQ ID NO: 1 Start Site | SEQ ID NO: 1 Stop Site | SEQ ID NO: 2 Start Site | SEQ ID NO: 2 Stop Site | Sequence (5' to 3') | PLP1 (% UTC) | SEQ ID No. |
|---|---|---|---|---|---|---|---|
| 1362611 | 1379 | 1398 | 17858 | 17877 | CCATTCCTTTGTGACTTGCA | 25 | 1543 |
| 1362620 | 1987 | 2006 | 18466 | 18485 | TCTCAGGTTACACCATTAGC | 49 | 1544 |
| 1362645 | 2088 | 2107 | 18567 | 18586 | CCATTGTGAAGATATGACAG | 73 | 1545 |
| 1362685 | 2868 | 2887 | 19347 | 19366 | CACTGTCCTTTATCTTGATT | 30 | 1546 |
| 1362722 | 3070 | 3089 | 19549 | 19568 | TTTGTAAGATAAGTTTCTAA | 61 | 1547 |
| 1362723 | 1813 | 1832 | 18292 | 18311 | ACGAGGTGTAAGGCCAGATG | 24 | 1548 |
| 1362729 | 1195 | 1214 | 17674 | 17693 | GGTGGCAAAGGCAAAGAGTT | 45 | 1549 |
| 1362730 | 2598 | 2617 | 19077 | 19096 | AAAAGACTGAAATCTGGGAG | 59 | 1550 |
| 1362771 | 1414 | 1433 | 17893 | 17912 | TCCTCAGGAGATGCTTGAAA | 66 | 1551 |
| 1362778 | 801 | 820 | 14860 | 14879 | TGAAGTAAATGTACACAGGC | 89 | 1552 |
| 1362780 | N/A | N/A | 7646 | 7665 | ACCACATTCAAGTGCTGGAA | 66 | 1553 |
| 1362784 | 2029 | 2048 | 18508 | 18527 | GCTATCCAAAGAGTTATCTA | 21 | 1554 |
| 1362785 | 1225 | 1244 | 17704 | 17723 | TACACTCATCAAGTAAGAAG | 53 | 1555 |
| 1362788 | 1064 | 1083 | 17543 | 17562 | GGCAAAGTTGTAAGTGGCAG | 31 | 1556 |
| 1362830 | 2062 | 2081 | 18541 | 18560 | GAGTACACAACTAATTAACA | 34 | 1557 |
| 1362855 | 2472 | 2491 | 18951 | 18970 | TAACCTTTATGTTAAACCTA | 50 | 1558 |
| 1362912 | N/A | N/A | 15503 | 15522 | TAACCCACTCACCTCAGCTG | 104† | 1559 |
| 1362952 | N/A | N/A | 16447 | 16466 | TTCAGAATAGCTGTACCCAC | 82 | 1560 |
| 1362956 | N/A | N/A | 8311 | 8330 | TCAACAGAACCAATGTGACT | 85 | 1561 |
| 1362969 | N/A | N/A | 5255 | 5274 | TGTTATAGATCTTGCCCATT | 54 | 1562 |
| 1363048 | 2309 | 2328 | 18788 | 18807 | TCAACTAGCCAATTTTTAAT | 52 | 1563 |
| 1363056 | N/A | N/A | 9128 | 9147 | AATCTCAGTCAGTCTGTCCA | 69 | 1564 |
| 1363089 | 1894 | 1913 | 18373 | 18392 | AAACCACAGGGTTGTCATGG | 60 | 1565 |
| 1363121 | 1732 | 1751 | 18211 | 18230 | GGCTTCAGTAGTCCATCGCC | 22 | 279 |
| 1363173 | 2911 | 2930 | 19390 | 19409 | TTATGTTATTAAATCAAAAC | 106 | 1566 |
| 1363222 | 2729 | 2748 | 19208 | 19227 | ATTGCTGAAACCACTTTGGG | 49 | 1567 |
| 1363232 | 2811 | 2830 | 19290 | 19309 | GCAGCCTGGAAGCTTATCTT | 20 | 1568 |
| 1363254 | 1753 | 1772 | 18232 | 18251 | AAGTAAGGTTGGCTGAGTTA | 81 | 1569 |
| 1363265 | 1856 | 1875 | 18335 | 18354 | AGGGAGTGAGAAGATGCTGA | 36 | 1570 |
| 1363278 | 2545 | 2564 | 19024 | 19043 | TTTTCCTGGAAGCTTACCAA | 49 | 1571 |
| 1363299 | N/A | N/A | 9393 | 9412 | ACATCCATTTTTCCTCTATT | 62 | 1572 |
| 1363341 | N/A | N/A | 17216 | 17235 | TGAACAATATTTGGGCTTTG | 66 | 1573 |
| 1363348 | 2445 | 2464 | 18924 | 18943 | ACACACCAAGATAACATTGC | 43 | 1574 |
| 1363381 | 1307 | 1326 | 17786 | 17805 | GAAGCAAAATGACTAAAAGA | 81 | 1575 |
| 1363384 | N/A | N/A | 8822 | 8841 | TCACATTTCCAGTCTAAGTA | 83 | 1576 |
| 1363426 | 1504 | 1523 | 17983 | 18002 | CAAAGACATTCCTTCTCTGT | 99 | 1577 |

TABLE 21-continued

Reduction of PLP1 RNA by 5-10-5 MOE gapmers with mixed PO/PS internucleoside linkages in SK-MEL-28 cells

| Compound ID | SEQ ID NO: 1 Start Site | SEQ ID NO: 1 Stop Site | SEQ ID NO: 2 Start Site | SEQ ID NO: 2 Stop Site | Sequence (5' to 3') | PLP1 (% UTC) | SEQ ID No. |
|---|---|---|---|---|---|---|---|
| 1363447 | 2275 | 2294 | 18754 | 18773 | TTAATGTCCAATTTTCCTAG | 67 | 1578 |
| 1363494 | N/A | N/A | 4086 | 4105 | ACACGACTCATTTAAACCAT | 60 | 1579 |
| 1363508 | N/A | N/A | 5547 | 5566 | TCCTCAGGGATTTCATCCCC | 104 | 1580 |
| 1363552 | 1536 | 1555 | 18015 | 18034 | ATATATTTGGCCCCTATAGA | 88 | 1581 |
| 1363554 | 2651 | 2670 | 19130 | 19149 | ATTAAAACCAATCAGACTTT | 88 | 1582 |
| 1363555 | 2681 | 2700 | 19160 | 19179 | AAAAGAACTGTAGTACAAAT | 83 | 1583 |
| 1363567 | 2391 | 2410 | 18870 | 18889 | GATCAGATTACTCAAATTGA | 32 | 1584 |
| 1363582 | 2170 | 2189 | 18649 | 18668 | GAAATGTGCATCATTCTAAA | 50 | 1585 |
| 1363593 | N/A | N/A | 12410 | 12429 | TGTGAGATTGACCCAGAATC | 80 | 1586 |
| 1363606 | N/A | N/A | 16947 | 16966 | GCACAATGAGCACACTACAT | 62 | 1587 |
| 1363618 | N/A | N/A | 11294 | 11313 | GCATGAAACATCTTTCTGGC | 50 | 1588 |
| 1363664 | 2499 | 2518 | 18978 | 18997 | TGTTATGTGATCTATATCAG | 46 | 1589 |
| 1363699 | N/A | N/A | 15847 | 15866 | CTATGAATGCCTCTGTGCAC | 69 | 1590 |
| 1363707 | 3005 | 3024 | 19484 | 19503 | ATGAAGGAAACACTTTCAGT | 60 | 1591 |
| 1363710 | N/A | N/A | 13379 | 13398 | ACATAAGTGAGGTATACACC | 79 | 1592 |
| 1363753 | 1332 | 1351 | 17811 | 17830 | CCCATTTCTAGCAGGAACCA | 35 | 1593 |
| 1363777 | N/A | N/A | 10122 | 10141 | ATTCCAGAAATTGATCTTCC | 76 | 1594 |
| 1363808 | 1265 | 1284 | 17744 | 17763 | AAAGAGAGACCTTAATCACT | 100 | 1595 |
| 1363827 | N/A | N/A | 16687 | 16706 | CGTAATTTATGACTGCAAAG | 45 | 1596 |
| 1363877 | 2776 | 2795 | 19255 | 19274 | AACAAGTATCAAGTGTCTTT | 31 | 1597 |
| 1363894 | 2246 | 2265 | 18725 | 18744 | CAGTCATAATCAAAGAATTA | 62 | 1598 |
| 1363981 | N/A | N/A | 6261 | 6280 | GTAACAGCCACTGTTCTCAG | 85 | 1599 |
| 1363987 | 2417 | 2436 | 18896 | 18915 | ATCATTTTCCATTAGCTAGA | 25 | 1600 |
| 1364001 | 1576 | 1595 | 18055 | 18074 | AGAGAGACCAGAATGAATTC | 82 | 1601 |
| 1364011 | N/A | N/A | 13962 | 13981 | TTGTACAAAGCATCCCACAA | 63 | 1602 |
| 1364050 | 1680 | 1699 | 18159 | 18178 | AGATCCTTGCTTTGACCCCC | 48 | 1603 |
| 1364088 | N/A | N/A | 4897 | 4916 | CAACTGAGTCTCATTTCATT | 81 | 1604 |
| 1364099 | 1624 | 1643 | 18103 | 18122 | TCTTATTGTTTTTCTGACAT | 32 | 1605 |
| 1364102 | 3031 | 3050 | 19510 | 19529 | GTTAAAATTGCAATTCTATA | 59 | 1606 |
| 1364103 | 2333 | 2352 | 18812 | 18831 | TACTTGTAGAAAATCCCAAT | 27 | 1607 |
| 1364133 | 2211 | 2230 | 18690 | 18709 | TGATGCAACCCCAAATAAGT | 44 | 1608 |
| 1364144 | N/A | N/A | 10829 | 10848 | TGAATAAGCAGGTTGTGACA | 65 | 1609 |
| 1364195 | 2364 | 2383 | 18843 | 18862 | ATTCACCAAATCTGTTTCTG | 34 | 1610 |
| 1364200 | N/A | N/A | 11764 | 11783 | AGACCTAATATTTTCAACTA | 78 | 1611 |

TABLE 22

Reduction of PLP1 RNA by 5-10-5 MOE gapmers with mixed PO/PS internucleoside linkages in SK-MEL-28 cells

| Compound ID | SEQ ID NO: 1 Start Site | SEQ ID NO: 1 Stop Site | SEQ ID NO: 2 Start Site | SEQ ID NO: 2 Stop Site | Sequence (5' to 3') | PLP1 (% UTC) | SEQ ID No. |
|---|---|---|---|---|---|---|---|
| 1362439 | N/A | N/A | 4053 | 4072 | CCCAAAGTTGGAAATTCTCT | 74 | 1612 |
| 1362441 | 1622 | 1641 | 18101 | 18120 | TTATTGTTTTTCTGACATTC | 34 | 1613 |
| 1362471 | 2114 | 2133 | 18593 | 18612 | ATGGATAATACCCCATGAAA | 77 | 1614 |
| 1362490 | 1731 | 1750 | 18210 | 18229 | GCTTCAGTAGTCCATCGCCA | 27 | 201 |
| 1362525 | 1448 | 1467 | 17927 | 17946 | TGGAAGTACCCTTTGAGAAG | 65 | 1615 |
| 1362535 | 1939 | 1958 | 18418 | 18437 | TCTGTTCTCATGTAAGCTAG | 19 | 1616 |
| 1362554 | 2244 | 2263 | 18723 | 18742 | GTCATAATCAAAGAATTATT | 33 | 1617 |
| 1362598 | 800 | 819 | 14859 | 14878 | GAAGTAAATGTACACAGGCA | 89 | 1618 |
| 1362643 | 2910 | 2929 | 19389 | 19408 | TATGTTATTAAATCAAAACA | 112 | 1619 |
| 1362679 | 1264 | 1283 | 17743 | 17762 | AAGAGAGACCTTAATCACTG | 49 | 1620 |
| 1362693 | N/A | N/A | 11762 | 11781 | ACCTAATATTTTCAACTAAC | 69 | 1621 |
| 1362708 | 1893 | 1912 | 18372 | 18391 | AACCACAGGGTTGTCATGGT | 26 | 1622 |
| 1362739 | 1331 | 1350 | 17810 | 17829 | CCATTTCTAGCAGGAACCAG | 50 | 1623 |
| 1362787 | N/A | N/A | 16937 | 16956 | CACACTACATTCACAGGGCA | 52 | 1624 |
| 1362828 | 2471 | 2490 | 18950 | 18969 | AACCTTTATGTTAAACCTAA | 37 | 1625 |
| 1362841 | 2308 | 2327 | 18787 | 18806 | CAACTAGCCAATTTTTAATA | 52 | 1626 |
| 1362851 | 2142 | 2161 | 18621 | 18640 | AGACCTTCAAATCACCTACG | 31 | 1627 |
| 1362865 | 1676 | 1695 | 18155 | 18174 | CCTTGCTTTGACCCCCTTCT | 56 | 1628 |
| 1362871 | 2597 | 2616 | 19076 | 19095 | AAAGACTGAAATCTGGGAGC | 31 | 1629 |
| 1362896 | N/A | N/A | 5546 | 5565 | CCTCAGGGATTTCATCCCCT | 100 | 1630 |
| 1362898 | 1063 | 1082 | 17542 | 17561 | GCAAAGTTGTAAGTGGCAGC | 52 | 1631 |
| 1362921 | 2332 | 2351 | 18811 | 18830 | ACTTGTAGAAAATCCCAATA | 40 | 1632 |
| 1362949 | 3030 | 3049 | 19509 | 19528 | TTAAAATTGCAATTCTATAT | 104 | 1633 |
| 1362954 | N/A | N/A | 15502 | 15521 | AACCCACTCACCTCAGCTGT | 104† | 1634 |
| 1363001 | N/A | N/A | 16413 | 16432 | ATTTACTTGCCAAGATCATT | 95 | 1635 |
| 1363010 | N/A | N/A | 15830 | 15849 | CACAGCCCATTTTCTTGATA | 55 | 1636 |
| 1363021 | 3069 | 3088 | 19548 | 19567 | TTGTAAGATAAGTTTCTAAA | 76 | 1637 |
| 1363028 | N/A | N/A | 17213 | 17232 | ACAATATTTGGGCTTTGCCA | 62 | 1638 |
| 1363044 | N/A | N/A | 7242 | 7261 | CAGGTCAGTCTCCCACCATT | 59 | 1639 |
| 1363067 | N/A | N/A | 13953 | 13972 | GCATCCCACAAAACTCATGC | 37 | 1640 |
| 1363121 | 1732 | 1751 | 18211 | 18230 | GGCTTCAGTAGTCCATCGCC | 15 | 279 |
| 1363125 | N/A | N/A | 5218 | 5237 | TTATTGTTACTTGATTCTCA | 61 | 1641 |
| 1363162 | 2028 | 2047 | 18507 | 18526 | CTATCCAAAGAGTTATCTAT | 44 | 1642 |
| 1363180 | 2168 | 2187 | 18647 | 18666 | AATGTGCATCATTCTAAAAC | 65 | 1643 |
| 1363181 | N/A | N/A | 6258 | 6277 | ACAGCCACTGTTCTCAGACG | 68 | 1644 |
| 1363246 | 1159 | 1178 | 17638 | 17657 | CATTGTAGGCTGTGTGGTTA | 72 | 1645 |

TABLE 22-continued

Reduction of PLP1 RNA by 5-10-5 MOE gapmers with mixed PO/PS internucleoside linkages in SK-MEL-28 cells

| Compound ID | SEQ ID NO: 1 Start Site | SEQ ID NO: 1 Stop Site | SEQ ID NO: 2 Start Site | SEQ ID NO: 2 Stop Site | Sequence (5' to 3') | PLP1 (% UTC) | SEQ ID No. |
|---|---|---|---|---|---|---|---|
| 1363316 | 2498 | 2517 | 18977 | 18996 | GTTATGTGATCTATATCAGG | 31 | 1646 |
| 1363317 | 3004 | 3023 | 19483 | 19502 | TGAAGGAAACACTTTCAGTT | 56 | 1647 |
| 1363321 | N/A | N/A | 8306 | 8325 | AGAACCAATGTGACTTACAC | 95 | 1648 |
| 1363339 | 1854 | 1873 | 18333 | 18352 | GGAGTGAGAAGATGCTGACA | 56 | 1649 |
| 1363353 | N/A | N/A | 16678 | 16697 | TGACTGCAAAGTACTTGGCA | 62 | 1650 |
| 1363371 | 2775 | 2794 | 19254 | 19273 | ACAAGTATCAAGTGTCTTTT | 36 | 1651 |
| 1363372 | 2544 | 2563 | 19023 | 19042 | TTTCCTGGAAGCTTACCAAC | 51 | 1652 |
| 1363373 | N/A | N/A | 10828 | 10847 | GAATAAGCAGGTTGTGACAG | 68 | 1653 |
| 1363392 | 1378 | 1397 | 17857 | 17876 | CATTCCTTTGTGACTTGCAG | 25 | 1654 |
| 1363417 | N/A | N/A | 11292 | 11311 | ATGAAACATCTTTCTGGCAC | 76 | 1655 |
| 1363478 | 2710 | 2729 | 19189 | 19208 | GGGAAAAGAACAACACAACT | 56 | 1656 |
| 1363483 | 2860 | 2879 | 19339 | 19358 | TTTATCTTGATTGGTTTCTT | 51 | 1657 |
| 1363522 | 2444 | 2463 | 18923 | 18942 | CACACCAAGATAACATTGCT | 44 | 1658 |
| 1363535 | 1306 | 1325 | 17785 | 17804 | AAGCAAAATGACTAAAAGAG | 91 | 1659 |
| 1363547 | 2679 | 2698 | 19158 | 19177 | AAGAACTGTAGTACAAATCT | 50 | 1660 |
| 1363633 | 2808 | 2827 | 19287 | 19306 | GCCTGGAAGCTTATCTTGTA | 22 | 1661 |
| 1363637 | N/A | N/A | 4872 | 4891 | TGTGTTTAAGCTGCTATCTT | 47 | 1662 |
| 1363649 | 2363 | 2382 | 18842 | 18861 | TTCACCAAATCTGTTTCTGC | 25 | 1663 |
| 1363659 | 2274 | 2293 | 18753 | 18772 | TAATGTCCAATTTTCCTAGT | 56 | 1664 |
| 1363702 | N/A | N/A | 9389 | 9408 | CCATTTTTCCTCTATTTTCT | 74 | 1665 |
| 1363738 | 1224 | 1243 | 17703 | 17722 | ACACTCATCAAGTAAGAAGA | 32 | 1666 |
| 1363813 | 1413 | 1432 | 17892 | 17911 | CCTCAGGAGATGCTTGAAAA | 46 | 1667 |
| 1363860 | 2061 | 2080 | 18540 | 18559 | AGTACACAACTAATTAACAG | 48 | 1668 |
| 1363869 | N/A | N/A | 9124 | 9143 | TCAGTCAGTCTGTCCAAGCA | 62 | 1669 |
| 1363870 | 2415 | 2434 | 18894 | 18913 | CATTTTCCATTAGCTAGAAA | 40 | 1670 |
| 1363873 | 2390 | 2409 | 18869 | 18888 | ATCAGATTACTCAAATTGAG | 37 | 1671 |
| 1363884 | 1812 | 1831 | 18291 | 18310 | CGAGGTGTAAGGCCAGATGC | 32 | 1672 |
| 1363909 | 1503 | 1522 | 17982 | 18001 | AAAGACATTCCTTCTCTGTA | 86 | 1673 |
| 1363974 | N/A | N/A | 10121 | 10140 | TTCCAGAAATTGATCTTCCT | 71 | 1674 |
| 1363985 | N/A | N/A | 5884 | 5903 | TCTAAAGTTCCTTCCAATCC | 86 | 1675 |
| 1364019 | 1534 | 1553 | 18013 | 18032 | ATATTTGGCCCCTATAGATG | 77 | 1676 |
| 1364029 | 1194 | 1213 | 17673 | 17692 | GTGGCAAAGGCAAAGAGTTA | 63 | 1677 |
| 1364030 | N/A | N/A | 12407 | 12426 | GAGATTGACCCAGAATCCTT | 52 | 1678 |
| 1364036 | 2650 | 2669 | 19129 | 19148 | TTAAAACCAATCAGACTTTT | 74 | 1679 |
| 1364072 | N/A | N/A | 13378 | 13397 | CATAAGTGAGGTATACACCA | 64 | 1680 |
| 1364077 | N/A | N/A | 6717 | 6736 | TTGTTATTACTCAGATCGCT | 64 | 1681 |

TABLE 22-continued

Reduction of PLP1 RNA by 5-10-5 MOE gapmers with mixed PO/PS internucleoside linkages in SK-MEL-28 cells

| Compound ID | SEQ ID NO: 1 Start Site | SEQ ID NO: 1 Stop Site | SEQ ID NO: 2 Start Site | SEQ ID NO: 2 Stop Site | Sequence (5' to 3') | PLP1 (% UTC) | SEQ ID No. |
|---|---|---|---|---|---|---|---|
| 1364152 | N/A | N/A | 8820 | 8839 | ACATTTCCAGTCTAAGTACA | 87 | 1682 |
| 1364157 | 2087 | 2106 | 18566 | 18585 | CATTGTGAAGATATGACAGA | 55 | 1683 |
| 1364180 | 1986 | 2005 | 18465 | 18484 | CTCAGGTTACACCATTAGCC | 29 | 210 |
| 1364206 | 1575 | 1594 | 18054 | 18073 | GAGAGACCAGAATGAATTCC | 33 | 1684 |
| 1364209 | N/A | N/A | 7645 | 7664 | CCACATTCAAGTGCTGGAAA | 61 | 1685 |
| 1364221 | 2210 | 2229 | 18689 | 18708 | GATGCAACCCCAAATAAGTA | 48 | 1686 |
| 1364270 | 1751 | 1770 | 18230 | 18249 | GTAAGGTTGGCTGAGTTAGG | 39 | 1687 |

TABLE 23

Reduction of PLP1 RNA by 5-10-5 MOE gapmers with mixed PO/PS internucleoside linkages in SK-MEL-28 cells

| Compound ID | SEQ ID NO: 1 Start Site | SEQ ID NO: 1 Stop Site | SEQ ID NO: 2 Start Site | SEQ ID NO: 2 Stop Site | Sequence (5' to 3') | PLP1 (% UTC) | SEQ ID No. |
|---|---|---|---|---|---|---|---|
| 1362463 | N/A | N/A | 16936 | 16955 | ACACTACATTCACAGGGCAC | 57 | 1688 |
| 1362472 | N/A | N/A | 10789 | 10808 | TTGTATTAATTACTTAGGCT | 98 | 1689 |
| 1362488 | N/A | N/A | 12406 | 12425 | AGATTGACCCAGAATCCTTA | 53 | 1690 |
| 1362490 | 1731 | 1750 | 18210 | 18229 | GCTTCAGTAGTCCATCGCCA | 18 | 201 |
| 1362497 | 1151 | 1170 | 17630 | 17649 | GCTGTGTGGTTAGAGCCTCG | 23 | 42 |
| 1362530 | N/A | N/A | 6255 | 6274 | GCCACTGTTCTCAGACGACA | 37 | 1691 |
| 1362589 | N/A | N/A | 7584 | 7603 | GGATAGTCAAATCATGTGGA | 55 | 1692 |
| 1362600 | 2497 | 2516 | 18976 | 18995 | TTATGTGATCTATATCAGGA | 40 | 1693 |
| 1362607 | 2596 | 2615 | 19075 | 19094 | AAGACTGAAATCTGGGAGCT | 35 | 1694 |
| 1362631 | 3068 | 3087 | 19547 | 19566 | TGTAAGATAAGTTTCTAAAA | 70 | 1695 |
| 1362633 | N/A | N/A | 5883 | 5902 | CTAAAGTTCCTTCCAATCCC | 73 | 1696 |
| 1362637 | 2060 | 2079 | 18539 | 18558 | GTACACAACTAATTAACAGA | 31 | 1697 |
| 1362648 | 1412 | 1431 | 17891 | 17910 | CTCAGGAGATGCTTGAAAAT | 72 | 1698 |
| 1362663 | 3003 | 3022 | 19482 | 19501 | GAAGGAAACACTTTCAGTTG | 50 | 1699 |
| 1362675 | 2086 | 2105 | 18565 | 18584 | ATTGTGAAGATATGACAGAG | 46 | 1700 |
| 1362710 | 1811 | 1830 | 18290 | 18309 | GAGGTGTAAGGCCAGATGCC | 44 | 1701 |
| 1362712 | 2362 | 2381 | 18841 | 18860 | TCACCAAATCTGTTTCTGCA | 22 | 1702 |
| 1362746 | 2773 | 2792 | 19252 | 19271 | AAGTATCAAGTGTCTTTTTG | 41 | 1703 |
| 1362764 | 2678 | 2697 | 19157 | 19176 | AGAACTGTAGTACAAATCTT | 50 | 1704 |
| 1362815 | 1984 | 2003 | 18463 | 18482 | CAGGTTACACCATTAGCCAC | 44 | 1705 |
| 1362886 | 2389 | 2408 | 18868 | 18887 | TCAGATTACTCAAATTGAGA | 38 | 1706 |
| 1362889 | 1892 | 1911 | 18371 | 18390 | ACCACAGGGTTGTCATGGTA | 45 | 1707 |
| 1362918 | 3029 | 3048 | 19508 | 19527 | TAAAATTGCAATTCTATATC | 114 | 1708 |

TABLE 23-continued

Reduction of PLP1 RNA by 5-10-5 MOE gapmers with mixed PO/PS internucleoside linkages in SK-MEL-28 cells

| Compound ID | SEQ ID NO: 1 Start Site | SEQ ID NO: 1 Stop Site | SEQ ID NO: 2 Start Site | SEQ ID NO: 2 Stop Site | Sequence (5' to 3') | PLP1 (% UTC) | SEQ ID No. |
|---|---|---|---|---|---|---|---|
| 1362960 | 797 | 816 | 14856 | 14875 | GTAAATGTACACAGGCACAG | 50 | 1709 |
| 1362971 | N/A | N/A | 16677 | 16696 | GACTGCAAAGTACTTGGCAA | 39 | 1710 |
| 1362988 | N/A | N/A | 9337 | 9356 | GCTCCACTACAGCTCAAAGC | 56 | 1711 |
| 1363026 | 1935 | 1954 | 18414 | 18433 | TTCTCATGTAAGCTAGTTTC | 33 | 1712 |
| 1363034 | 1675 | 1694 | 18154 | 18173 | CTTGCTTTGACCCCCTTCTC | 70 | 1713 |
| 1363112 | 1330 | 1349 | 17809 | 17828 | CATTTCTAGCAGGAACCAGC | 59 | 1714 |
| 1363121 | 1732 | 1751 | 18211 | 18230 | GGCTTCAGTAGTCCATCGCC | 20 | 279 |
| 1363195 | N/A | N/A | 4052 | 4071 | CCAAAGTTGGAAATTCTCTT | 63 | 1715 |
| 1363345 | N/A | N/A | 13374 | 13393 | AGTGAGGTATACACCAGAGC | 40 | 1716 |
| 1363393 | 1744 | 1763 | 18223 | 18242 | TGGCTGAGTTAGGGCTTCAG | 23 | 1717 |
| 1363394 | N/A | N/A | 11753 | 11772 | TTTCAACTAACAATTCAGGC | 52 | 1718 |
| 1363397 | 2414 | 2433 | 18893 | 18912 | ATTTTCCATTAGCTAGAAAG | 47 | 1719 |
| 1363401 | 1501 | 1520 | 17980 | 17999 | AGACATTCCTTCTCTGTACC | 50 | 1720 |
| 1363409 | 2443 | 2462 | 18922 | 18941 | ACACCAAGATAACATTGCTA | 35 | 1721 |
| 1363413 | N/A | N/A | 15756 | 15775 | TCTATCTTTACCTAAAGCTA | 58 | 1722 |
| 1363503 | 2908 | 2927 | 19387 | 19406 | TGTTATTAAATCAAAACAAA | 89 | 1723 |
| 1363511 | 2709 | 2728 | 19188 | 19207 | GGAAAAGAACAACACAACTC | 56 | 1724 |
| 1363563 | N/A | N/A | 15333 | 15352 | ATCTCTAATTATCCTGGCTG | 70 | 1725 |
| 1363571 | N/A | N/A | 11290 | 11309 | GAAACATCTTTCTGGCACTA | 54 | 1726 |
| 1363603 | 2141 | 2160 | 18620 | 18639 | GACCTTCAAATCACCTACGA | 37 | 289 |
| 1363619 | 2470 | 2489 | 18949 | 18968 | ACCTTTATGTTAAACCTAAC | 46 | 1727 |
| 1363691 | 1620 | 1639 | 18099 | 18118 | ATTGTTTTTCTGACATTCTT | 38 | 1728 |
| 1363696 | 1574 | 1593 | 18053 | 18072 | AGAGACCAGAATGAATTCCA | 18 | 1729 |
| 1363708 | 2243 | 2262 | 18722 | 18741 | TCATAATCAAAGAATTATTC | 75 | 1730 |
| 1363747 | 2272 | 2291 | 18751 | 18770 | ATGTCCAATTTTCCTAGTTT | 28 | 1731 |
| 1363792 | 1533 | 1552 | 18012 | 18031 | TATTTGGCCCCTATAGATGG | 90 | 1732 |
| 1363795 | 1374 | 1393 | 17853 | 17872 | CCTTTGTGACTTGCAGTTGG | 35 | 1733 |
| 1363815 | 2113 | 2132 | 18592 | 18611 | TGGATAATACCCCATGAAAT | 40 | 1734 |
| 1363818 | 2307 | 2326 | 18786 | 18805 | AACTAGCCAATTTTTAATAT | 52 | 1735 |
| 1363842 | 1192 | 1211 | 17671 | 17690 | GGCAAAGGCAAAGAGTTAAG | 28 | 1736 |
| 1363850 | 1262 | 1281 | 17741 | 17760 | GAGAGACCTTAATCACTGCA | 24 | 1737 |
| 1363863 | N/A | N/A | 17212 | 17231 | CAATATTTGGGCTTTGCCAC | 60 | 1738 |
| 1363881 | 2331 | 2350 | 18810 | 18829 | CTTGTAGAAAATCCCAATAG | 45 | 1739 |
| 1363890 | 2167 | 2186 | 18646 | 18665 | ATGTGCATCATTCTAAAACA | 41 | 1740 |
| 1363914 | 1447 | 1466 | 17926 | 17945 | GGAAGTACCCTTTGAGAAGA | 64 | 1741 |
| 1363938 | N/A | N/A | 16410 | 16429 | TACTTGCCAAGATCATTCAA | 98 | 1742 |

TABLE 23-continued

Reduction of PLP1 RNA by 5-10-5 MOE gapmers with mixed PO/PS internucleoside linkages in SK-MEL-28 cells

| Compound ID | SEQ ID NO: 1 Start Site | SEQ ID NO: 1 Stop Site | SEQ ID NO: 2 Start Site | SEQ ID NO: 2 Stop Site | Sequence (5' to 3') | PLP1 (% UTC) | SEQ ID No. |
|---|---|---|---|---|---|---|---|
| 1363948 | N/A | N/A | 5214 | 5233 | TGTTACTTGATTCTCACAAC | 45 | 1743 |
| 1363960 | 2649 | 2668 | 19128 | 19147 | TAAAACCAATCAGACTTTTT | 65 | 1744 |
| 1363967 | 1223 | 1242 | 17702 | 17721 | CACTCATCAAGTAAGAAGAG | 53 | 1745 |
| 1363978 | 2856 | 2875 | 19335 | 19354 | TCTTGATTGGTTTCTTACAA | 27 | 1746 |
| 1364013 | N/A | N/A | 4871 | 4890 | GTGTTTAAGCTGCTATCTTT | 38 | 1747 |
| 1364022 | N/A | N/A | 5527 | 5546 | TGAGGAAGTAATATTCAACA | 86 | 1748 |
| 1364025 | N/A | N/A | 10093 | 10112 | ACAGGTTAAGATACTAGATT | 59 | 1749 |
| 1364034 | 1062 | 1081 | 17541 | 17560 | CAAAGTTGTAAGTGGCAGCA | 38 | 1750 |
| 1364045 | 2805 | 2824 | 19284 | 19303 | TGGAAGCTTATCTTGTATAC | 43 | 1751 |
| 1364062 | N/A | N/A | 8815 | 8834 | TCCAGTCTAAGTACAGACTG | 98 | 1752 |
| 1364064 | N/A | N/A | 13950 | 13969 | TCCCACAAAACTCATGCTTT | 40 | 1753 |
| 1364092 | N/A | N/A | 6532 | 6551 | GCTGCACTTGATTATTTTAG | 47 | 1754 |
| 1364121 | 2543 | 2562 | 19022 | 19041 | TTCCTGGAAGCTTACCAACT | 40 | 1755 |
| 1364137 | 1853 | 1872 | 18332 | 18351 | GAGTGAGAAGATGCTGACAA | 48 | 1756 |
| 1364142 | 1305 | 1324 | 17784 | 17803 | AGCAAAATGACTAAAAGAGG | 56 | 1757 |
| 1364151 | 2208 | 2227 | 18687 | 18706 | TGCAACCCCAAATAAGTAAT | 33 | 1758 |
| 1364176 | 2027 | 2046 | 18506 | 18525 | TATCCAAAGAGTTATCTATC | 53 | 1759 |
| 1364219 | N/A | N/A | 9114 | 9133 | TGTCCAAGCAAGAATCAGAT | 69 | 1760 |
| 1364234 | N/A | N/A | 8297 | 8316 | GTGACTTACACAGATCCAGG | 51 | 1761 |
| 1364236 | N/A | N/A | 7230 | 7249 | CCACCATTTCCTCCTCTCTC | 53 | 1762 |

TABLE 24

Reduction of PLP1 RNA by 5-10-5 MOE gapmers with mixed PO/PS internucleoside linkages in SK-MEL-28 cells

| Compound ID | SEQ ID NO: 1 Start Site | SEQ ID NO: 1 Stop Site | SEQ ID NO: 2 Start Site | SEQ ID NO: 2 Stop Site | Sequence (5' to 3') | PLP1 (% UTC) | SEQ ID No. |
|---|---|---|---|---|---|---|---|
| 1362462 | N/A | N/A | 10090 | 10109 | GGTTAAGATACTAGATTCAG | 76 | 1763 |
| 1362490 | 1731 | 1750 | 18210 | 18229 | GCTTCAGTAGTCCATCGCCA | 30 | 201 |
| 1362495 | N/A | N/A | 13949 | 13968 | CCCACAAAACTCATGCTTTC | 52 | 1764 |
| 1362520 | 2085 | 2104 | 18564 | 18583 | TTGTGAAGATATGACAGAGG | 37 | 1765 |
| 1362601 | N/A | N/A | 5841 | 5860 | TACTGCAATTGTTGAACAGC | 90 | 1766 |
| 1362666 | 1260 | 1279 | 17739 | 17758 | GAGACCTTAATCACTGCAAG | 43 | 1767 |
| 1362672 | 1329 | 1348 | 17808 | 17827 | ATTTCTAGCAGGAACCAGCT | 49 | 1768 |
| 1362674 | 1191 | 1210 | 17670 | 17689 | GCAAAGGCAAAGAGTTAAGA | 66 | 1769 |
| 1362818 | 1891 | 1910 | 18370 | 18389 | CCACAGGGTTGTCATGGTAG | 44 | 1770 |

TABLE 24-continued

Reduction of PLP1 RNA by 5-10-5 MOE gapmers with mixed PO/PS internucleoside linkages in SK-MEL-28 cells

| Compound ID | SEQ ID NO: 1 Start Site | SEQ ID NO: 1 Stop Site | SEQ ID NO: 2 Start Site | SEQ ID NO: 2 Stop Site | Sequence (5' to 3') | PLP1 (% UTC) | SEQ ID No. |
|---|---|---|---|---|---|---|---|
| 1362870 | N/A | N/A | 5490 | 5509 | TCTGTTTTTAATGCACAACC | 66 | 1771 |
| 1362892 | 2495 | 2514 | 18974 | 18993 | ATGTGATCTATATCAGGAGA | 28 | 1772 |
| 1362907 | 2242 | 2261 | 18721 | 18740 | CATAATCAAAGAATTATTCT | 85 | 1773 |
| 1362917 | 2271 | 2290 | 18750 | 18769 | TGTCCAATTTTCCTAGTTTA | 34 | 1774 |
| 1362920 | N/A | N/A | 16935 | 16954 | CACTACATTCACAGGGCACT | 60 | 1775 |
| 1362935 | 795 | 814 | 14854 | 14873 | AAATGTACACAGGCACAGCA | 72 | 1776 |
| 1362941 | 2306 | 2325 | 18785 | 18804 | ACTAGCCAATTTTTAATATC | 53 | 1777 |
| 1362947 | 2899 | 2918 | 19378 | 19397 | ATCAAAACAAAACACAAGGT | 57 | 1778 |
| 1362970 | 1148 | 1167 | 17627 | 17646 | GTGTGGTTAGAGCCTCGCTA | 23 | 197 |
| 1363006 | N/A | N/A | 11241 | 11260 | GTGTCTTAAAGTGCTAAGAG | 37 | 1779 |
| 1363014 | 3028 | 3047 | 19507 | 19526 | AAAATTGCAATTCTATATCA | 64 | 1780 |
| 1363015 | 2677 | 2696 | 19156 | 19175 | GAACTGTAGTACAAATCTTT | 51 | 1781 |
| 1363017 | 1573 | 1592 | 18052 | 18071 | GAGACCAGAATGAATTCCAT | 33 | 1782 |
| 1363057 | N/A | N/A | 15306 | 15325 | GGATTCTACCAACAATCAGG | 66 | 1783 |
| 1363065 | N/A | N/A | 9336 | 9355 | CTCCACTACAGCTCAAAGCA | 73 | 1784 |
| 1363072 | N/A | N/A | 8760 | 8779 | TAATAACATTTCTCAATGCA | 87 | 1785 |
| 1363076 | 2360 | 2379 | 18839 | 18858 | ACCAAATCTGTTTCTGCAAA | 28 | 1786 |
| 1363088 | 2026 | 2045 | 18505 | 18524 | ATCCAAAGAGTTATCTATCC | 45 | 1787 |
| 1363098 | 2853 | 2872 | 19332 | 19351 | TGATTGGTTTCTTACAAAAC | 49 | 1788 |
| 1363102 | N/A | N/A | 17196 | 17215 | CCACATCAATATGTCCGAGT | 19 | 253 |
| 1363120 | N/A | N/A | 7184 | 7203 | GGAACCTTATTCTCTTCCTT | 37 | 1789 |
| 1363121 | 1732 | 1751 | 18211 | 18230 | GGCTTCAGTAGTCCATCGCC | 17 | 279 |
| 1363133 | 2442 | 2461 | 18921 | 18940 | CACCAAGATAACATTGCTAA | 39 | 1790 |
| 1363152 | 2166 | 2185 | 18645 | 18664 | TGTGCATCATTCTAAAACAA | 30 | 1791 |
| 1363203 | 2140 | 2159 | 18619 | 18638 | ACCTTCAAATCACCTACGAT | 57 | 1792 |
| 1363266 | 2112 | 2131 | 18591 | 18610 | GGATAATACCCCATGAAATG | 28 | 1793 |
| 1363269 | 1810 | 1829 | 18289 | 18308 | AGGTGTAAGGCCAGATGCCC | 39 | 1794 |
| 1363275 | N/A | N/A | 4800 | 4819 | ACAAAGACCCTTGTGCTCTG | 81 | 1795 |
| 1363282 | 2759 | 2778 | 19238 | 19257 | TTTTTGTAAAGCTCTTACAT | 62 | 1796 |
| 1363297 | N/A | N/A | 15752 | 15771 | TCTTTACCTAAAGCTACAAA | 91 | 1797 |
| 1363304 | 2059 | 2078 | 18538 | 18557 | TACACAACTAATTAACAGAA | 75 | 1798 |
| 1363315 | 2804 | 2823 | 19283 | 19302 | GGAAGCTTATCTTGTATACT | 21 | 1799 |
| 1363360 | 1499 | 1518 | 17978 | 17997 | ACATTCCTTCTCTGTACCTG | 38 | 1800 |
| 1363378 | N/A | N/A | 11752 | 11771 | TTCAACTAACAATTCAGGCA | 42 | 1801 |
| 1363400 | 1982 | 2001 | 18461 | 18480 | GGTTACACCATTAGCCACCA | 25 | 1802 |
| 1363403 | 1304 | 1323 | 17783 | 17802 | GCAAAATGACTAAAAGAGGT | 61 | 1803 |

TABLE 24-continued

Reduction of PLP1 RNA by 5-10-5 MOE gapmers with mixed PO/PS internucleoside linkages in SK-MEL-28 cells

| Compound ID | SEQ ID NO: 1 Start Site | SEQ ID NO: 1 Stop Site | SEQ ID NO: 2 Start Site | SEQ ID NO: 2 Stop Site | Sequence (5' to 3') | PLP1 (% UTC) | SEQ ID No. |
|---|---|---|---|---|---|---|---|
| 1363456 | 2595 | 2614 | 19074 | 19093 | AGACTGAAATCTGGGAGCTA | 49 | 1804 |
| 1363459 | 1222 | 1241 | 17701 | 17720 | ACTCATCAAGTAAGAAGAGG | 29 | 1805 |
| 1363463 | 1444 | 1463 | 17923 | 17942 | AGTACCCTTTGAGAAGAAAT | 48 | 1806 |
| 1363517 | 2207 | 2226 | 18686 | 18705 | GCAACCCCAAATAAGTAATA | 23 | 1807 |
| 1363526 | N/A | N/A | 16675 | 16694 | CTGCAAAGTACTTGGCAACA | 34 | 1808 |
| 1363537 | N/A | N/A | 8295 | 8314 | GACTTACACAGATCCAGGTT | 67 | 1809 |
| 1363587 | 2468 | 2487 | 18947 | 18966 | CTTTATGTTAAACCTAACTC | 45 | 1810 |
| 1363625 | 1060 | 1079 | 17539 | 17558 | AAGTTGTAAGTGGCAGCAAT | 92 | 1811 |
| 1363667 | 3067 | 3086 | 19546 | 19565 | GTAAGATAAGTTTCTAAAAG | 71 | 1812 |
| 1363670 | 1527 | 1546 | 18006 | 18025 | GCCCCTATAGATGGCAAGAG | 53 | 1813 |
| 1363672 | 1674 | 1693 | 18153 | 18172 | TTGCTTTGACCCCCTTCTCC | 74 | 1814 |
| 1363701 | 1743 | 1762 | 18222 | 18241 | GGCTGAGTTAGGGCTTCAGT | 21 | 1815 |
| 1363712 | N/A | N/A | 6244 | 6263 | CAGACGACAACAGGCTTGCA | 88 | 1816 |
| 1363713 | 2413 | 2432 | 18892 | 18911 | TTTTCCATTAGCTAGAAAGA | 50 | 1817 |
| 1363731 | 3002 | 3021 | 19481 | 19500 | AAGGAAACACTTTCAGTTGA | 62 | 1818 |
| 1363772 | N/A | N/A | 16409 | 16428 | ACTTGCCAAGATCATTCAAA | 86 | 1819 |
| 1363830 | 2388 | 2407 | 18867 | 18886 | CAGATTACTCAAATTGAGAT | 39 | 1820 |
| 1363838 | 1933 | 1952 | 18412 | 18431 | CTCATGTAAGCTAGTTTCCT | 27 | 1821 |
| 1363849 | N/A | N/A | 7581 | 7600 | TAGTCAAATCATGTGGACAA | 52 | 1822 |
| 1363861 | 2330 | 2349 | 18809 | 18828 | TTGTAGAAAATCCCAATAGA | 51 | 1823 |
| 1363874 | N/A | N/A | 4001 | 4020 | GCTAAAGTTTTTGAAACTTA | 124 | 1824 |
| 1363918 | N/A | N/A | 13373 | 13392 | GTGAGGTATACACCAGAGCG | 55 | 1825 |
| 1363927 | 1411 | 1430 | 17890 | 17909 | TCAGGAGATGCTTGAAAATT | 62 | 1826 |
| 1363936 | 1852 | 1871 | 18331 | 18350 | AGTGAGAAGATGCTGACAAC | 40 | 1827 |
| 1363955 | 2648 | 2667 | 19127 | 19146 | AAAACCAATCAGACTTTTTT | 53 | 1828 |
| 1363962 | N/A | N/A | 5213 | 5232 | GTTACTTGATTCTCACAACC | 29 | 1829 |
| 1364037 | N/A | N/A | 12401 | 12420 | GACCCAGAATCCTTACTTTG | 64 | 1830 |
| 1364058 | 1370 | 1389 | 17849 | 17868 | TGTGACTTGCAGTTGGGAAG | 47 | 1831 |
| 1364097 | 1618 | 1637 | 18097 | 18116 | TGTTTTTCTGACATTCTTTT | 34 | 1832 |
| 1364173 | N/A | N/A | 9112 | 9131 | TCCAAGCAAGAATCAGATTT | 77 | 1833 |
| 1364203 | N/A | N/A | 10788 | 10807 | TGTATTAATTACTTAGGCTT | 74 | 1834 |
| 1364226 | 2708 | 2727 | 19187 | 19206 | GAAAAGAACAACACAACTCT | 60 | 1835 |
| 1364259 | N/A | N/A | 6527 | 6546 | ACTTGATTATTTTAGTCAGT | 44 | 1836 |
| 1364267 | 2542 | 2561 | 19021 | 19040 | TCCTGGAAGCTTACCAACTG | 42 | 1837 |

TABLE 25

Reduction of PLP1 RNA by 5-10-5 MOE gapmers with mixed PO/PS internucleoside linkages in SK-MEL-28 cells

| Compound ID | SEQ ID NO: 1 Start Site | SEQ ID NO: 1 Stop Site | SEQ ID NO: 2 Start Site | SEQ ID NO: 2 Stop Site | Sequence (5' to 3') | PLP1 (% UTC) | SEQ ID No. |
|---|---|---|---|---|---|---|---|
| 805563 | 1058 | 1077 | 17537 | 17556 | GTTGTAAGTGGCAGCAATCA | 55 | 1838 |
| 1362438 | 2647 | 2666 | 19126 | 19145 | AAACCAATCAGACTTTTTTT | 54 | 1839 |
| 1362452 | N/A | N/A | 13369 | 13388 | GGTATACACCAGAGCGAGCA | 67 | 1840 |
| 1362490 | 1731 | 1750 | 18210 | 18229 | GCTTCAGTAGTCCATCGCCA | 16 | 201 |
| 1362494 | 1890 | 1909 | 18369 | 18388 | CACAGGGTTGTCATGGTAGC | 58 | 1841 |
| 1362523 | 2139 | 2158 | 18618 | 18637 | CCTTCAAATCACCTACGATG | 50 | 1842 |
| 1362563 | N/A | N/A | 5488 | 5507 | TGTTTTTAATGCACAACCTA | 114 | 1843 |
| 1362572 | N/A | N/A | 6524 | 6543 | TGATTATTTTAGTCAGTGTC | 73 | 1844 |
| 1362608 | 2387 | 2406 | 18866 | 18885 | AGATTACTCAAATTGAGATT | 72 | 1845 |
| 1362628 | 2898 | 2917 | 19377 | 19396 | TCAAAACAAAACACAAGGTA | 65 | 1846 |
| 1362698 | 265 | 284 | 3975 | 3994 | TCTTTGGGACTCTGACTCCA | 100 | 1847 |
| 1362713 | 2164 | 2183 | 18643 | 18662 | TGCATCATTCTAAAACAAAT | 48 | 1848 |
| 1362728 | N/A | N/A | 15742 | 15761 | AAGCTACAAACTTCTCTTTT | 91 | 1849 |
| 1362749 | 1147 | 1166 | 17626 | 17645 | TGTGGTTAGAGCCTCGCTAT | 34 | 1850 |
| 1362759 | 2706 | 2725 | 19185 | 19204 | AAAGAACAACACAACTCTTT | 71 | 1851 |
| 1362786 | N/A | N/A | 7067 | 7086 | TTAATCAATCAGTACTTGCT | 107 | 1852 |
| 1362793 | 1410 | 1429 | 17889 | 17908 | CAGGAGATGCTTGAAAATTC | 54 | 1853 |
| 1362798 | 2676 | 2695 | 19155 | 19174 | AACTGTAGTACAAATCTTTC | 65 | 1854 |
| 1362807 | N/A | N/A | 10089 | 10108 | GTTAAGATACTAGATTCAGC | 101 | 1855 |
| 1362813 | 2852 | 2871 | 19331 | 19350 | GATTGGTTTCTTACAAAACA | 19 | 1856 |
| 1362824 | 1981 | 2000 | 18460 | 18479 | GTTACACCATTAGCCACCAG | 79 | 1857 |
| 1362847 | 1608 | 1627 | 18087 | 18106 | ACATTCTTTTTTCTTCTATC | 56 | 1858 |
| 1362861 | 2539 | 2558 | 19018 | 19037 | TGGAAGCTTACCAACTGAAT | 81 | 1859 |
| 1362876 | 1851 | 1870 | 18330 | 18349 | GTGAGAAGATGCTGACAACA | 35 | 1860 |
| 1362929 | N/A | N/A | 16934 | 16953 | ACTACATTCACAGGGCACTG | 68 | 1861 |
| 1362931 | N/A | N/A | 15305 | 15324 | GATTCTACCAACAATCAGGA | 134 | 1862 |
| 1362989 | 2441 | 2460 | 18920 | 18939 | ACCAAGATAACATTGCTAAG | 57 | 1863 |
| 1363047 | N/A | N/A | 8758 | 8777 | ATAACATTTCTCAATGCAAC | 61 | 1864 |
| 1363054 | N/A | N/A | 13905 | 13924 | GGAACCTTTGAAAGGTGAGG | 46 | 1865 |
| 1363087 | N/A | N/A | 6243 | 6262 | AGACGACAACAGGCTTGCAG | 88 | 1866 |
| 1363111 | N/A | N/A | 12395 | 12414 | GAATCCTTACTTTGTTTCAT | 65 | 1867 |
| 1363121 | 1732 | 1751 | 18211 | 18230 | GGCTTCAGTAGTCCATCGCC | 34 | 279 |
| 1363149 | 1806 | 1825 | 18285 | 18304 | GTAAGGCCAGATGCCCCCTT | 56 | 1868 |
| 1363164 | N/A | N/A | 14681 | 14700 | AAACCAGGTTCCAGGGCTCT | 61 | 1869 |
| 1363241 | 1328 | 1347 | 17807 | 17826 | TTTCTAGCAGGAACCAGCTA | 67 | 1870 |
| 1363260 | 1742 | 1761 | 18221 | 18240 | GCTGAGTTAGGGCTTCAGTA | 45 | 1871 |

TABLE 25-continued

Reduction of PLP1 RNA by 5-10-5 MOE gapmers with mixed PO/PS internucleoside linkages in SK-MEL-28 cells

| Compound ID | SEQ ID NO: 1 Start Site | SEQ ID NO: 1 Stop Site | SEQ ID NO: 2 Start Site | SEQ ID NO: 2 Stop Site | Sequence (5' to 3') | PLP1 (% UTC) | SEQ ID No. |
|---|---|---|---|---|---|---|---|
| 1363277 | 1221 | 1240 | 17700 | 17719 | CTCATCAAGTAAGAAGAGGG | 34 | 1872 |
| 1363324 | 2329 | 2348 | 18808 | 18827 | TGTAGAAAATCCCAATAGAT | 60 | 1873 |
| 1363325 | 2241 | 2260 | 18720 | 18739 | ATAATCAAAGAATTATTCTC | 76 | 1874 |
| 1363335 | 1443 | 1462 | 17922 | 17941 | GTACCCTTTGAGAAGAAATT | 53 | 1875 |
| 1363369 | N/A | N/A | 4796 | 4815 | AGACCCTTGTGCTCTGCACA | 43 | 1876 |
| 1363379 | N/A | N/A | 11751 | 11770 | TCAACTAACAATTCAGGCAG | 72 | 1877 |
| 1363418 | N/A | N/A | 9103 | 9122 | GAATCAGATTTTAGATTCTA | 118 | 1878 |
| 1363430 | 1491 | 1510 | 17970 | 17989 | TCTCTGTACCTGAGCATCTT | 37 | 1879 |
| 1363465 | 2206 | 2225 | 18685 | 18704 | CAACCCCAAATAAGTAATAA | 66 | 1880 |
| 1363538 | 1572 | 1591 | 18051 | 18070 | AGACCAGAATGAATTCCATT | 44 | 1881 |
| 1363588 | 2758 | 2777 | 19237 | 19256 | TTTTGTAAAGCTCTTACATC | 74 | 1882 |
| 1363594 | 2467 | 2486 | 18946 | 18965 | TTTATGTTAAACCTAACTCT | 87 | 1883 |
| 1363658 | N/A | N/A | 10771 | 10790 | CTTGGATTTTTGTATTCAAG | 73 | 1884 |
| 1363745 | 1526 | 1545 | 18005 | 18024 | CCCCTATAGATGGCAAGAGG | 83 | 1885 |
| 1363769 | 2305 | 2324 | 18784 | 18803 | CTAGCCAATTTTTAATATCA | 35 | 1886 |
| 1363780 | 1190 | 1209 | 17669 | 17688 | CAAAGGCAAAGAGTTAAGAT | 77 | 1887 |
| 1363791 | 2412 | 2431 | 18891 | 18910 | TTTCCATTAGCTAGAAAGAA | 46 | 1888 |
| 1363801 | 3000 | 3019 | 19479 | 19498 | GGAAACACTTTCAGTTGATT | 21 | 1889 |
| 1363802 | 2803 | 2822 | 19282 | 19301 | GAAGCTTATCTTGTATACTG | 26 | 1890 |
| 1363807 | 2359 | 2378 | 18838 | 18857 | CCAAATCTGTTTCTGCAAAG | 52 | 1891 |
| 1363828 | N/A | N/A | 5211 | 5230 | TACTTGATTCTCACAACCCT | 83 | 1892 |
| 1363839 | 3027 | 3046 | 19506 | 19525 | AAATTGCAATTCTATATCAG | 100 | 1893 |
| 1363867 | 1673 | 1692 | 18152 | 18171 | TGCTTTGACCCCCTTCTCCC | 76 | 1894 |
| 1363893 | N/A | N/A | 16673 | 16692 | GCAAAGTACTTGGCAACATT | 50 | 1895 |
| 1363911 | N/A | N/A | 5840 | 5859 | ACTGCAATTGTTGAACAGCA | 58 | 1896 |
| 1363923 | N/A | N/A | 9335 | 9354 | TCCACTACAGCTCAAAGCAA | 82 | 1897 |
| 1363942 | 2111 | 2130 | 18590 | 18609 | GATAATACCCCATGAAATGA | 82 | 1898 |
| 1363963 | N/A | N/A | 17177 | 17196 | TGACTTAGAGTCATAGGGTG | 81 | 1899 |
| 1364033 | N/A | N/A | 16326 | 16345 | AGGTCATTTGGAACTGCAGG | 59† | 1900 |
| 1364040 | 2493 | 2512 | 18972 | 18991 | GTGATCTATATCAGGAGAAA | 44 | 1901 |
| 1364068 | 1302 | 1321 | 17781 | 17800 | AAAATGACTAAAAGAGGTAC | 106 | 1902 |
| 1364075 | N/A | N/A | 7579 | 7598 | GTCAAATCATGTGGACAAGG | 72 | 1903 |
| 1364096 | 2025 | 2044 | 18504 | 18523 | TCCAAAGAGTTATCTATCCT | 43 | 1904 |
| 1364108 | 3066 | 3085 | 19545 | 19564 | TAAGATAAGTTTCTAAAAGT | 93 | 1905 |
| 1364110 | 2594 | 2613 | 19073 | 19092 | GACTGAAATCTGGGAGCTAT | 38 | 1906 |
| 1364149 | N/A | N/A | 11158 | 11177 | GCACACAAGAAGTCACAGGC | 41 | 1907 |

TABLE 25-continued

Reduction of PLP1 RNA by 5-10-5 MOE gapmers with mixed PO/PS internucleoside linkages in SK-MEL-28 cells

| Compound ID | SEQ ID NO: 1 Start Site | SEQ ID NO: 1 Stop Site | SEQ ID NO: 2 Start Site | SEQ ID NO: 2 Stop Site | Sequence (5' to 3') | PLP1 (% UTC) | SEQ ID No. |
|---|---|---|---|---|---|---|---|
| 1364154 | 2269 | 2288 | 18748 | 18767 | TCCAATTTTCCTAGTTTAAA | 59 | 1908 |
| 1364167 | 2058 | 2077 | 18537 | 18556 | ACACAACTAATTAACAGAAA | 103 | 1909 |
| 1364184 | N/A | N/A | 8294 | 8313 | ACTTACACAGATCCAGGTTC | 98 | 1910 |
| 1364186 | 2084 | 2103 | 18563 | 18582 | TGTGAAGATATGACAGAGGC | 59 | 1911 |
| 1364212 | 1369 | 1388 | 17848 | 17867 | GTGACTTGCAGTTGGGAAGT | 47 | 1912 |
| 1364222 | 1259 | 1278 | 17738 | 17757 | AGACCTTAATCACTGCAAGA | 60 | 1913 |
| 1364266 | 1932 | 1951 | 18411 | 18430 | TCATGTAAGCTAGTTTCCTT | 46 | 1914 |

TABLE 26

Reduction of PLP1 RNA by 5-10-5 MOE gapmers with mixed PO/PS internucleoside linkages in SK-MEL-28 cells

| Compound ID | SEQ ID NO: 1 Start Site | SEQ ID NO: 1 Stop Site | SEQ ID NO: 2 Start Site | SEQ ID NO: 2 Stop Site | Sequence (5' to 3') | PLP1 (% UTC) | SEQ ID No. |
|---|---|---|---|---|---|---|---|
| 1362434 | 2897 | 2916 | 19376 | 19395 | CAAAACAAAACACAAGGTAC | 80 | 1915 |
| 1362470 | N/A | N/A | 11750 | 11769 | CAACTAACAATTCAGGCAGC | 88 | 1916 |
| 1362480 | N/A | N/A | 13904 | 13923 | GAACCTTTGAAAGGTGAGGC | 77 | 1917 |
| 1362490 | 1731 | 1750 | 18210 | 18229 | GCTTCAGTAGTCCATCGCCA | 23 | 201 |
| 1362504 | 2304 | 2323 | 18783 | 18802 | TAGCCAATTTTTAATATCAT | 99 | 1918 |
| 1362537 | 2057 | 2076 | 18536 | 18555 | CACAACTAATTAACAGAAAA | 122 | 1919 |
| 1362540 | N/A | N/A | 14679 | 14698 | ACCAGGTTCCAGGGCTCTCC | 39 | 1920 |
| 1362576 | N/A | N/A | 5836 | 5855 | CAATTGTTGAACAGCAGTGC | 82 | 1921 |
| 1362579 | 1889 | 1908 | 18368 | 18387 | ACAGGGTTGTCATGGTAGCT | 36 | 1922 |
| 1362596 | 2591 | 2610 | 19070 | 19089 | TGAAATCTGGGAGCTATTCA | 102 | 1923 |
| 1362614 | 1220 | 1239 | 17699 | 17718 | TCATCAAGTAAGAAGAGGGC | 73 | 1924 |
| 1362627 | 2328 | 2347 | 18807 | 18826 | GTAGAAAATCCCAATAGATT | 49 | 1925 |
| 1362646 | N/A | N/A | 9334 | 9353 | CCACTACAGCTCAAAGCAAG | 117 | 1926 |
| 1362743 | N/A | N/A | 6241 | 6260 | ACGACAACAGGCTTGCAGAC | 91 | 1927 |
| 1362753 | N/A | N/A | 8290 | 8309 | ACACAGATCCAGGTTCATCA | 80 | 1928 |
| 1362754 | 2411 | 2430 | 18890 | 18909 | TTCCATTAGCTAGAAAGAAC | 54 | 1929 |
| 1362773 | 1741 | 1760 | 18220 | 18239 | CTGAGTTAGGGCTTCAGTAG | 39 | 1930 |
| 1362777 | N/A | N/A | 16291 | 16310 | GAACTGTTTCTTGCAACAGC | 98 | 1931 |
| 1362834 | 1850 | 1869 | 18329 | 18348 | TGAGAAGATGCTGACAACAC | 92 | 1932 |
| 1362848 | 2850 | 2869 | 19329 | 19348 | TTGGTTTCTTACAAAACATT | 57 | 1933 |
| 1362853 | 1258 | 1277 | 17737 | 17756 | GACCTTAATCACTGCAAGAC | 61 | 1934 |
| 1362862 | N/A | N/A | 17175 | 17194 | ACTTAGAGTCATAGGGTGCT | 38 | 1935 |
| 1362869 | N/A | N/A | 16672 | 16691 | CAAAGTACTTGGCAACATTA | 87 | 1936 |

TABLE 26-continued

Reduction of PLP1 RNA by 5-10-5 MOE gapmers with mixed PO/PS internucleoside linkages in SK-MEL-28 cells

| Compound ID | SEQ ID NO: 1 Start Site | SEQ ID NO: 1 Stop Site | SEQ ID NO: 2 Start Site | SEQ ID NO: 2 Stop Site | Sequence (5' to 3') | PLP1 (% UTC) | SEQ ID No. |
|---|---|---|---|---|---|---|---|
| 1362882 | 1366 | 1385 | 17845 | 17864 | ACTTGCAGTTGGGAAGTCAT | 61 | 1937 |
| 1362904 | 2757 | 2776 | 19236 | 19255 | TTTGTAAAGCTCTTACATCT | 39 | 1938 |
| 1362915 | 2163 | 2182 | 18642 | 18661 | GCATCATTCTAAAACAAATC | 36 | 1939 |
| 1362919 | 2024 | 2043 | 18503 | 18522 | CCAAAGAGTTATCTATCCTG | 50 | 1940 |
| 1362937 | N/A | N/A | 5210 | 5229 | ACTTGATTCTCACAACCCTG | 40 | 1941 |
| 1362959 | N/A | N/A | 7484 | 7503 | TGTTTCCTATACTCCCCACT | 66 | 1942 |
| 1362964 | N/A | N/A | 10086 | 10105 | AAGATACTAGATTCAGCCTA | 111 | 1943 |
| 1362990 | 1301 | 1320 | 17780 | 17799 | AAATGACTAAAAGAGGTACA | 87 | 1944 |
| 1362998 | 2268 | 2287 | 18747 | 18766 | CCAATTTTCCTAGTTTAAAA | 63 | 1945 |
| 1363050 | 2357 | 2376 | 18836 | 18855 | AAATCTGTTTCTGCAAAGGC | 55 | 1946 |
| 1363070 | 1672 | 1691 | 18151 | 18170 | GCTTTGACCCCCTTCTCCCA | 63 | 1947 |
| 1363119 | 2083 | 2102 | 18562 | 18581 | GTGAAGATATGACAGAGGCC | 49 | 1948 |
| 1363121 | 1732 | 1751 | 18211 | 18230 | GGCTTCAGTAGTCCATCGCC | 18 | 279 |
| 1363124 | 2386 | 2405 | 18865 | 18884 | GATTACTCAAATTGAGATTC | 40 | 1949 |
| 1363138 | N/A | N/A | 15302 | 15321 | TCTACCAACAATCAGGATCC | 84 | 1950 |
| 1363163 | 2798 | 2817 | 19277 | 19296 | TTATCTTGTATACTGGTTTG | 32 | 1951 |
| 1363218 | N/A | N/A | 16932 | 16951 | TACATTCACAGGGCACTGTA | 89 | 1952 |
| 1363236 | 1602 | 1621 | 18081 | 18100 | TTTTTTCTTCTATCTTCAGT | 75 | 1953 |
| 1363238 | 247 | 266 | 3957 | 3976 | CAATTGTAGCCGGCTGGCTA | 99 | 1954 |
| 1363262 | N/A | N/A | 4784 | 4803 | TCTGCACACATTACTCTGAG | 79 | 1955 |
| 1363274 | 1327 | 1346 | 17806 | 17825 | TTCTAGCAGGAACCAGCTAT | 58 | 1956 |
| 1363284 | 2466 | 2485 | 18945 | 18964 | TTATGTTAAACCTAACTCTT | 98 | 1957 |
| 1363286 | 1804 | 1823 | 18283 | 18302 | AAGGCCAGATGCCCCCTTCG | 38 | 1958 |
| 1363302 | 1407 | 1426 | 17886 | 17905 | GAGATGCTTGAAAATTCAAT | 55 | 1959 |
| 1363352 | 2205 | 2224 | 18684 | 18703 | AACCCCAAATAAGTAATAAA | 48 | 1960 |
| 1363366 | 1189 | 1208 | 17668 | 17687 | AAAGGCAAAGAGTTAAGATG | 98 | 1961 |
| 1363420 | N/A | N/A | 5454 | 5473 | CTGACATTAGATAGGATTCC | 107 | 1962 |
| 1363432 | 2999 | 3018 | 19478 | 19497 | GAAACACTTTCAGTTGATTA | 75 | 1963 |
| 1363461 | N/A | N/A | 11157 | 11176 | CACACAAGAAGTCACAGGCT | 82 | 1964 |
| 1363474 | 1146 | 1165 | 17625 | 17644 | GTGGTTAGAGCCTCGCTATT | 28 | 1965 |
| 1363477 | 1442 | 1461 | 17921 | 17940 | TACCCTTTGAGAAGAAATTA | 86 | 1966 |
| 1363515 | 2110 | 2129 | 18589 | 18608 | ATAATACCCCATGAAATGAG | 70 | 1967 |
| 1363627 | 2675 | 2694 | 19154 | 19173 | ACTGTAGTACAAATCTTTCC | 23 | 1968 |
| 1363657 | 3026 | 3045 | 19505 | 19524 | AATTGCAATTCTATATCAGA | 84 | 1969 |
| 1363690 | 2138 | 2157 | 18617 | 18636 | CTTCAAATCACCTACGATGA | 73 | 1970 |
| 1363724 | 1571 | 1590 | 18050 | 18069 | GACCAGAATGAATTCCATTT | 31 | 1971 |

TABLE 26-continued

Reduction of PLP1 RNA by 5-10-5 MOE gapmers with mixed PO/PS internucleoside linkages in SK-MEL-28 cells

| Compound ID | SEQ ID NO: 1 Start Site | SEQ ID NO: 1 Stop Site | SEQ ID NO: 2 Start Site | SEQ ID NO: 2 Stop Site | Sequence (5' to 3') | PLP1 (% UTC) | SEQ ID No. |
|---|---|---|---|---|---|---|---|
| 1363739 | N/A | N/A | 11990 | 12009 | TCAGCAATTCAAATAGCAAG | 89 | 1972 |
| 1363743 | 1980 | 1999 | 18459 | 18478 | TTACACCATTAGCCACCAGC | 61 | 1973 |
| 1363774 | N/A | N/A | 6518 | 6537 | TTTTAGTCAGTGTCTCCAGG | 76 | 1974 |
| 1363845 | 1929 | 1948 | 18408 | 18427 | TGTAAGCTAGTTTCCTTCTA | 52 | 1975 |
| 1363880 | 2492 | 2511 | 18971 | 18990 | TGATCTATATCAGGAGAAAA | 75 | 1976 |
| 1363896 | 1525 | 1544 | 18004 | 18023 | CCCTATAGATGGCAAGAGGA | 74 | 1977 |
| 1363906 | 3065 | 3084 | 19544 | 19563 | AAGATAAGTTTCTAAAAGTT | 81 | 1978 |
| 1363910 | N/A | N/A | 7066 | 7085 | TAATCAATCAGTACTTGCTG | 77 | 1979 |
| 1363928 | 2240 | 2259 | 18719 | 18738 | TAATCAAAGAATTATTCTCC | 90 | 1980 |
| 1363941 | 2440 | 2459 | 18919 | 18938 | CCAAGATAACATTGCTAAGT | 44 | 1981 |
| 1363966 | N/A | N/A | 9099 | 9118 | CAGATTTTAGATTCTAACTG | 118 | 1982 |
| 1363986 | 2646 | 2665 | 19125 | 19144 | AACCAATCAGACTTTTTTTT | 67 | 1983 |
| 1364004 | N/A | N/A | 15711 | 15730 | GGTTGGAAAGGAAGTCTTTC | 65 | 1984 |
| 1364014 | N/A | N/A | 13368 | 13387 | GTATACACCAGAGCGAGCAC | 67 | 1985 |
| 1364053 | 2538 | 2557 | 19017 | 19036 | GGAAGCTTACCAACTGAATA | 75 | 1986 |
| 1364087 | 2705 | 2724 | 19184 | 19203 | AAGAACAACACAACTCTTTA | 85 | 1987 |
| 1364143 | 1487 | 1506 | 17966 | 17985 | TGTACCTGAGCATCTTTCCT | 37 | 1988 |
| 1364168 | 1057 | 1076 | 17536 | 17555 | TTGTAAGTGGCAGCAATCAT | 61 | 1989 |
| 1364194 | N/A | N/A | 10768 | 10787 | GGATTTTTGTATTCAAGCAT | 99 | 1990 |
| 1364211 | N/A | N/A | 8755 | 8774 | ACATTTCTCAATGCAACTCA | 60 | 1991 |

TABLE 27

Reduction of PLP1 RNA by 5-10-5 MOE gapmers with mixed PO/PS internucleoside linkages in SK-MEL-28 cells

| Compound ID | SEQ ID NO: 1 Start Site | SEQ ID NO: 1 Stop Site | SEQ ID NO: 2 Start Site | SEQ ID NO: 2 Stop Site | Sequence (5' to 3') | PLP1 (% UTC) | SEQ ID No. |
|---|---|---|---|---|---|---|---|
| 1362457 | 2384 | 2403 | 18863 | 18882 | TTACTCAAATTGAGATTCAA | 48 | 1992 |
| 1362469 | N/A | N/A | 9235 | 9254 | AAGCTATAAACAATTCAGTA | 78 | 1993 |
| 1362475 | 1978 | 1997 | 18457 | 18476 | ACACCATTAGCCACCAGCAA | 53 | 1994 |
| 1362484 | 1144 | 1163 | 17623 | 17642 | GGTTAGAGCCTCGCTATTAG | 32 | 119 |
| 1362490 | 1731 | 1750 | 18210 | 18229 | GCTTCAGTAGTCCATCGCCA | 20 | 201 |
| 1362501 | 184 | 203 | 3894 | 3913 | CTCTCCAGCCTCCTTCTTCG | 76 | 1995 |
| 1362546 | 2356 | 2375 | 18835 | 18854 | AATCTGTTTCTGCAAAGGCA | 38 | 1996 |
| 1362552 | 2796 | 2815 | 19275 | 19294 | ATCTTGTATACTGGTTTGAA | 47 | 1997 |
| 1362574 | 2847 | 2866 | 19326 | 19345 | GTTTCTTACAAAACATTTTC | 32 | 1998 |

TABLE 27-continued

| Reduction of PLP1 RNA by 5-10-5 MOE gapmers with mixed PO/PS internucleoside linkages in SK-MEL-28 cells | | | | | | | |
|---|---|---|---|---|---|---|---|
| Compound ID | SEQ ID NO: 1 Start Site | SEQ ID NO: 1 Stop Site | SEQ ID NO: 2 Start Site | SEQ ID NO: 2 Stop Site | Sequence (5' to 3') | PLP1 (% UTC) | SEQ ID No. |
| 1362592 | N/A | N/A | 16910 | 16929 | ACTATCAGCAAGACCTGGGA | 77 | 1999 |
| 1362594 | 2109 | 2128 | 18588 | 18607 | TAATACCCCATGAAATGAGC | 50 | 2000 |
| 1362616 | 1300 | 1319 | 17779 | 17798 | AATGACTAAAAGAGGTACAT | 61 | 2001 |
| 1362659 | 1786 | 1805 | 18265 | 18284 | CGTCTACACAGATTCTACGC | 28 | 2002 |
| 1362700 | 1927 | 1946 | 18406 | 18425 | TAAGCTAGTTTCCTTCTATT | 53 | 2003 |
| 1362719 | 2239 | 2258 | 18718 | 18737 | AATCAAAGAATTATTCTCCA | 40 | 2004 |
| 1362721 | 2439 | 2458 | 18918 | 18937 | CAAGATAACATTGCTAAGTA | 67 | 2005 |
| 1362751 | N/A | N/A | 13364 | 13383 | ACACCAGAGCGAGCACCTTA | 65 | 2006 |
| 1362768 | 2896 | 2915 | 19375 | 19394 | AAAACAAAACACAAGGTACG | 75 | 2007 |
| 1362808 | 2755 | 2774 | 19234 | 19253 | TGTAAAGCTCTTACATCTCC | 31 | 2008 |
| 1362820 | N/A | N/A | 7404 | 7423 | ATGATGTACACATTCCAATT | 67 | 2009 |
| 1362842 | 3025 | 3044 | 19504 | 19523 | ATTGCAATTCTATATCAGAA | 28 | 2010 |
| 1362879 | N/A | N/A | 11156 | 11175 | ACACAAGAAGTCACAGGCTC | 65 | 2011 |
| 1362881 | N/A | N/A | 8272 | 8291 | CAAGGGACTGTGTTGATCCT | 67 | 2012 |
| 1362993 | 1056 | 1075 | 17535 | 17554 | TGTAAGTGGCAGCAATCATG | 36 | 2013 |
| 1363022 | 1569 | 1588 | 18048 | 18067 | CCAGAATGAATTCCATTTTG | 25 | 2014 |
| 1363024 | 1441 | 1460 | 17920 | 17939 | ACCCTTTGAGAAGAAATTAC | 60 | 2015 |
| 1363053 | 1326 | 1345 | 17805 | 17824 | TCTAGCAGGAACCAGCTATG | 63 | 2016 |
| 1363121 | 1732 | 1751 | 18211 | 18230 | GGCTTCAGTAGTCCATCGCC | 29 | 279 |
| 1363171 | 2704 | 2723 | 19183 | 19202 | AGAACAACACAACTCTTTAC | 57 | 2017 |
| 1363186 | 2327 | 2346 | 18806 | 18825 | TAGAAAATCCCAATAGATTC | 52 | 2018 |
| 1363229 | 2204 | 2223 | 18683 | 18702 | ACCCCAAATAAGTAATAAAC | 39 | 2019 |
| 1363242 | 2162 | 2181 | 18641 | 18660 | CATCATTCTAAAACAAATCA | 52 | 2020 |
| 1363258 | N/A | N/A | 6500 | 6519 | GGAAGACTAGGTGAACATGC | 67 | 2021 |
| 1363327 | N/A | N/A | 8656 | 8675 | GTTTATGTGAATTCAGTACA | 54 | 2022 |
| 1363330 | N/A | N/A | 14525 | 14544 | GCTTCAGAGGATGTTTTTGG | 27 | 2023 |
| 1363365 | 2265 | 2284 | 18744 | 18763 | ATTTTCCTAGTTTAAAAAAC | 77 | 2024 |
| 1363368 | 1365 | 1384 | 17844 | 17863 | CTTGCAGTTGGGAAGTCATC | 64 | 2025 |
| 1363375 | 1740 | 1759 | 18219 | 18238 | TGAGTTAGGGCTTCAGTAGT | 50 | 2026 |
| 1363377 | N/A | N/A | 9016 | 9035 | TGAGAAAAGATCCATTGGGC | 70 | 2027 |
| 1363411 | N/A | N/A | 5453 | 5472 | TGACATTAGATAGGATTCCT | 88 | 2028 |
| 1363444 | N/A | N/A | 11749 | 11768 | AACTAACAATTCAGGCAGCC | 57 | 2029 |
| 1363468 | 2465 | 2484 | 18944 | 18963 | TATGTTAAACCTAACTCTTA | 77 | 2030 |
| 1363481 | N/A | N/A | 5835 | 5854 | AATTGTTGAACAGCAGTGCA | 97 | 2031 |
| 1363497 | N/A | N/A | 6239 | 6258 | GACAACAGGCTTGCAGACAA | 43 | 2032 |
| 1363502 | 1881 | 1900 | 18360 | 18379 | GTCATGGTAGCTGTTATCAA | 28 | 2033 |

TABLE 27-continued

Reduction of PLP1 RNA by 5-10-5 MOE gapmers with mixed PO/PS internucleoside linkages in SK-MEL-28 cells

| Compound ID | SEQ ID NO: 1 Start Site | SEQ ID NO: 1 Stop Site | SEQ ID NO: 2 Start Site | SEQ ID NO: 2 Stop Site | Sequence (5' to 3') | PLP1 (% UTC) | SEQ ID No. |
|---|---|---|---|---|---|---|---|
| 1363505 | N/A | N/A | 15301 | 15320 | CTACCAACAATCAGGATCCT | 75 | 2034 |
| 1363512 | 2491 | 2510 | 18970 | 18989 | GATCTATATCAGGAGAAAAT | 50 | 2035 |
| 1363548 | N/A | N/A | 16255 | 16274 | GTAAATCATGAATACAGCTT | 43 | 2036 |
| 1363560 | 1671 | 1690 | 18150 | 18169 | CTTTGACCCCCTTCTCCCAG | 73 | 2037 |
| 1363572 | 1257 | 1276 | 17736 | 17755 | ACCTTAATCACTGCAAGACT | 58 | 2038 |
| 1363574 | N/A | N/A | 5150 | 5169 | TGAGGAAGTGGTGATTCAGT | 100 | 2039 |
| 1363612 | 2590 | 2609 | 19069 | 19088 | GAAATCTGGGAGCTATTCAG | 46 | 2040 |
| 1363616 | 3064 | 3083 | 19543 | 19562 | AGATAAGTTTCTAAAAGTTT | 68 | 2041 |
| 1363617 | N/A | N/A | 16670 | 16689 | AAGTACTTGGCAACATTACA | 45 | 2042 |
| 1363624 | 2023 | 2042 | 18502 | 18521 | CAAAGAGTTATCTATCCTGT | 83 | 2043 |
| 1363629 | 1406 | 1425 | 17885 | 17904 | AGATGCTTGAAAATTCAATT | 47 | 2044 |
| 1363695 | 1188 | 1207 | 17667 | 17686 | AAGGCAAAGAGTTAAGATGG | 63 | 2045 |
| 1363723 | 1486 | 1505 | 17965 | 17984 | GTACCTGAGCATCTTTCCTT | 29 | 2046 |
| 1363726 | N/A | N/A | 11989 | 12008 | CAGCAATTCAAATAGCAAGC | 39 | 2047 |
| 1363766 | 2410 | 2429 | 18889 | 18908 | TCCATTAGCTAGAAAGAACG | 45 | 2048 |
| 1363779 | N/A | N/A | 10767 | 10786 | GATTTTTGTATTCAAGCATT | 73 | 2049 |
| 1363793 | 2627 | 2646 | 19106 | 19125 | TTTTTTAACCCAAAGTTAAC | 80 | 2050 |
| 1363821 | N/A | N/A | 13886 | 13905 | GCTAAGCCAGCTGGGCACCA | 61 | 2051 |
| 1363855 | 1849 | 1868 | 18328 | 18347 | GAGAAGATGCTGACAACACC | 47 | 2052 |
| 1363859 | N/A | N/A | 10085 | 10104 | AGATACTAGATTCAGCCTAT | 85 | 2053 |
| 1363925 | 2302 | 2321 | 18781 | 18800 | GCCAATTTTTAATATCATTT | 36 | 2054 |
| 1363940 | 2674 | 2693 | 19153 | 19172 | CTGTAGTACAAATCTTTCCT | 28 | 2055 |
| 1363961 | 2082 | 2101 | 18561 | 18580 | TGAAGATATGACAGAGGCCA | 44 | 2056 |
| 1363977 | 2997 | 3016 | 19476 | 19495 | AACACTTTCAGTTGATTAAC | 59 | 2057 |
| 1363979 | N/A | N/A | 4782 | 4801 | TGCACACATTACTCTGAGTA | 72 | 2058 |
| 1363992 | 2137 | 2156 | 18616 | 18635 | TTCAAATCACCTACGATGAC | 76 | 2059 |
| 1364027 | 2056 | 2075 | 18535 | 18554 | ACAACTAATTAACAGAAAAA | 102 | 2060 |
| 1364080 | 1595 | 1614 | 18074 | 18093 | TTCTATCTTCAGTGGTAATA | 47 | 2061 |
| 1364172 | N/A | N/A | 15707 | 15726 | GGAAAGGAAGTCTTTCTATG | 52 | 2062 |
| 1364199 | 1219 | 1238 | 17698 | 17717 | CATCAAGTAAGAAGAGGGCC | 61 | 2063 |
| 1364214 | N/A | N/A | 7063 | 7082 | TCAATCAGTACTTGCTGAGC | 51 | 2064 |
| 1364237 | N/A | N/A | 17174 | 17193 | CTTAGAGTCATAGGGTGCTT | 63 | 2065 |
| 1364254 | 1524 | 1543 | 18003 | 18022 | CCTATAGATGGCAAGAGGAC | 72 | 2066 |
| 1364268 | 2537 | 2556 | 19016 | 19035 | GAAGCTTACCAACTGAATAG | 43 | 2067 |

TABLE 28

Reduction of PLP1 RNA by 5-10-5 MOE gapmers with mixed PO/PS internucleoside linkages in SK-MEL-28 cells

| Compound ID | SEQ ID NO: 1 Start Site | SEQ ID NO: 1 Stop Site | SEQ ID NO: 2 Start Site | SEQ ID NO: 2 Stop Site | Sequence (5' to 3') | PLP1 (% UTC) | SEQ ID No. |
|---|---|---|---|---|---|---|---|
| 1362440 | 2996 | 3015 | 19475 | 19494 | ACACTTTCAGTTGATTAACT | 35 | 2068 |
| 1362444 | N/A | N/A | 15299 | 15318 | ACCAACAATCAGGATCCTCT | 70 | 2069 |
| 1362455 | 2409 | 2428 | 18888 | 18907 | CCATTAGCTAGAAAGAACGA | 50 | 2070 |
| 1362490 | 1731 | 1750 | 18210 | 18229 | GCTTCAGTAGTCCATCGCCA | 13 | 201 |
| 1362502 | 1299 | 1318 | 17778 | 17797 | ATGACTAAAAGAGGTACATA | 84 | 2071 |
| 1362522 | N/A | N/A | 14521 | 14540 | CAGAGGATGTTTTTGGGCAG | 40 | 2072 |
| 1362585 | 2301 | 2320 | 18780 | 18799 | CCAATTTTTAATATCATTTG | 67 | 2073 |
| 1362605 | N/A | N/A | 11987 | 12006 | GCAATTCAAATAGCAAGCCA | 31 | 2074 |
| 1362654 | N/A | N/A | 11128 | 11147 | GCTGTGTTCCAAGTACTAGT | 66 | 2075 |
| 1362667 | N/A | N/A | 7062 | 7081 | CAATCAGTACTTGCTGAGCT | 38 | 2076 |
| 1362668 | N/A | N/A | 10763 | 10782 | TTTGTATTCAAGCATTTCTC | 70 | 2077 |
| 1362673 | N/A | N/A | 10084 | 10103 | GATACTAGATTCAGCCTATA | 72 | 2078 |
| 1362717 | N/A | N/A | 5120 | 5139 | AGGTCACATAGTTCATAAGT | 88 | 2079 |
| 1362727 | 1053 | 1072 | 17532 | 17551 | AAGTGGCAGCAATCATGAAG | 50 | 2080 |
| 1362734 | 1785 | 1804 | 18264 | 18283 | GTCTACACAGATTCTACGCT | 30 | 285 |
| 1362760 | 2795 | 2814 | 19274 | 19293 | TCTTGTATACTGGTTTGAAA | 55 | 2081 |
| 1362762 | N/A | N/A | 17170 | 17189 | GAGTCATAGGGTGCTTGCTG | 54 | 2082 |
| 1362772 | N/A | N/A | 16909 | 16928 | CTATCAGCAAGACCTGGGAC | 66 | 2083 |
| 1362790 | 1924 | 1943 | 18403 | 18422 | GCTAGTTTCCTTCTATTCTC | 15 | 2084 |
| 1362837 | 1364 | 1383 | 17843 | 17862 | TTGCAGTTGGGAAGTCATCT | 41 | 2085 |
| 1362845 | 2464 | 2483 | 18943 | 18962 | ATGTTAAACCTAACTCTTAA | 53 | 2086 |
| 1362891 | N/A | N/A | 6438 | 6457 | GCATTCTTGCCATTTTGATG | 51 | 2087 |
| 1362894 | N/A | N/A | 13759 | 13778 | CCCAATTTTCCCCCACCCCT | 63 | 2088 |
| 1362901 | 2081 | 2100 | 18560 | 18579 | GAAGATATGACAGAGGCCAG | 36 | 2089 |
| 1362903 | 1977 | 1996 | 18456 | 18475 | CACCATTAGCCACCAGCAAC | 36 | 2090 |
| 1362927 | 1735 | 1754 | 18214 | 18233 | TAGGGCTTCAGTAGTCCATC | 12 | 2091 |
| 1362972 | 1405 | 1424 | 17884 | 17903 | GATGCTTGAAAATTCAATTA | 34 | 2092 |
| 1363094 | 2895 | 2914 | 19374 | 19393 | AAACAAAACACAAGGTACGG | 27 | 2093 |
| 1363121 | 1732 | 1751 | 18211 | 18230 | GGCTTCAGTAGTCCATCGCC | 25 | 279 |
| 1363132 | 2536 | 2555 | 19015 | 19034 | AAGCTTACCAACTGAATAGC | 47 | 2094 |
| 1363153 | 3023 | 3042 | 19502 | 19521 | TGCAATTCTATATCAGAAAT | 38 | 2095 |
| 1363156 | N/A | N/A | 15705 | 15724 | AAAGGAAGTCTTTCTATGCA | 60 | 2096 |
| 1363194 | 2108 | 2127 | 18587 | 18606 | AATACCCCATGAAATGAGCA | 33 | 2097 |
| 1363210 | 1256 | 1275 | 17735 | 17754 | CCTTAATCACTGCAAGACTC | 37 | 2098 |
| 1363226 | 2018 | 2037 | 18497 | 18516 | AGTTATCTATCCTGTGTCTA | 51 | 2099 |
| 1363233 | 2589 | 2608 | 19068 | 19087 | AAATCTGGGAGCTATTCAGG | 50 | 2100 |

TABLE 28-continued

Reduction of PLP1 RNA by 5-10-5 MOE gapmers with mixed PO/PS internucleoside linkages in SK-MEL-28 cells

| Compound ID | SEQ ID NO: 1 Start Site | SEQ ID NO: 1 Stop Site | SEQ ID NO: 2 Start Site | SEQ ID NO: 2 Stop Site | Sequence (5' to 3') | PLP1 (% UTC) | SEQ ID No. |
|---|---|---|---|---|---|---|---|
| 1363235 | 2673 | 2692 | 19152 | 19171 | TGTAGTACAAATCTTTCCTT | 16 | 2101 |
| 1363249 | 2160 | 2179 | 18639 | 18658 | TCATTCTAAAACAAATCAAG | 80 | 2102 |
| 1363267 | N/A | N/A | 7403 | 7422 | TGATGTACACATTCCAATTT | 54 | 2103 |
| 1363310 | 1880 | 1899 | 18359 | 18378 | TCATGGTAGCTGTTATCAAG | 35 | 2104 |
| 1363312 | 1187 | 1206 | 17666 | 17685 | AGGCAAAGAGTTAAGATGGG | 40 | 2105 |
| 1363334 | 2845 | 2864 | 19324 | 19343 | TTCTTACAAAACATTTTCCC | 42 | 2106 |
| 1363336 | N/A | N/A | 8169 | 8188 | GCTCCATGATGGAAATTCAG | 68 | 2107 |
| 1363402 | 2625 | 2644 | 19104 | 19123 | TTTTAACCCAAAGTTAACAA | 64 | 2108 |
| 1363415 | 1141 | 1160 | 17620 | 17639 | TAGAGCCTCGCTATTAGAGA | 24 | 2109 |
| 1363471 | N/A | N/A | 9013 | 9032 | GAAAAGATCCATTGGGCTCC | 56 | 2110 |
| 1363485 | 2754 | 2773 | 19233 | 19252 | GTAAAGCTCTTACATCTCCT | 11 | 2111 |
| 1363540 | 2136 | 2155 | 18615 | 18634 | TCAAATCACCTACGATGACT | 71 | 2112 |
| 1363561 | 2203 | 2222 | 18682 | 18701 | CCCCAAATAAGTAATAAACA | 36 | 2113 |
| 1363562 | N/A | N/A | 5833 | 5852 | TTGTTGAACAGCAGTGCACT | 85 | 2114 |
| 1363600 | N/A | N/A | 6230 | 6249 | CTTGCAGACAATGTTTTGCT | 40 | 2115 |
| 1363615 | 1325 | 1344 | 17804 | 17823 | CTAGCAGGAACCAGCTATGA | 36 | 2116 |
| 1363669 | N/A | N/A | 5452 | 5471 | GACATTAGATAGGATTCCTG | 93 | 2117 |
| 1363689 | 2263 | 2282 | 18742 | 18761 | TTTCCTAGTTTAAAAAACAG | 72 | 2118 |
| 1363717 | 2055 | 2074 | 18534 | 18553 | CAACTAATTAACAGAAAAAA | 92 | 2119 |
| 1363719 | 1844 | 1863 | 18323 | 18342 | GATGCTGACAACACCCTGTT | 40 | 2120 |
| 1363740 | 2490 | 2509 | 18969 | 18988 | ATCTATATCAGGAGAAAATA | 68 | 2121 |
| 1363749 | N/A | N/A | 16665 | 16684 | CTTGGCAACATTACATGTTC | 38 | 2122 |
| 1363752 | 1218 | 1237 | 17697 | 17716 | ATCAAGTAAGAAGAGGGCCA | 50 | 2123 |
| 1363784 | 1440 | 1459 | 17919 | 17938 | CCCTTTGAGAAGAAATTACT | 48 | 2124 |
| 1363832 | 2437 | 2456 | 18916 | 18935 | AGATAACATTGCTAAGTAAA | 60 | 2125 |
| 1363853 | 2238 | 2257 | 18717 | 18736 | ATCAAAGAATTATTCTCCAG | 38 | 2126 |
| 1363862 | 1555 | 1574 | 18034 | 18053 | ATTTTGTACACCAAAGAGAA | 70 | 2127 |
| 1363898 | N/A | N/A | 9227 | 9246 | AACAATTCAGTAATATCAGC | 54 | 2128 |
| 1363908 | 1485 | 1504 | 17964 | 17983 | TACCTGAGCATCTTTCCTTC | 38 | 2129 |
| 1363926 | N/A | N/A | 13301 | 13320 | CATGCTTTCACCTTATCTTT | 47 | 2130 |
| 1363939 | 1523 | 1542 | 18002 | 18021 | CTATAGATGGCAAGAGGACC | 67 | 2131 |
| 1363944 | N/A | N/A | 16251 | 16270 | ATCATGAATACAGCTTTCTG | 74 | 2132 |
| 1363973 | 2326 | 2345 | 18805 | 18824 | AGAAAATCCCAATAGATTCA | 37 | 2133 |
| 1363989 | 1594 | 1613 | 18073 | 18092 | TCTATCTTCAGTGGTAATAG | 29 | 2134 |
| 1364057 | N/A | N/A | 11748 | 11767 | ACTAACAATTCAGGCAGCCA | 47 | 2135 |
| 1364076 | 3063 | 3082 | 19542 | 19561 | GATAAGTTTCTAAAAGTTTA | 56 | 2136 |

TABLE 28-continued

Reduction of PLP1 RNA by 5-10-5 MOE gapmers with mixed PO/PS internucleoside linkages in SK-MEL-28 cells

| Compound ID | SEQ ID NO: 1 Start Site | SEQ ID NO: 1 Stop Site | SEQ ID NO: 2 Start Site | SEQ ID NO: 2 Stop Site | Sequence (5' to 3') | PLP1 (% UTC) | SEQ ID No. |
|---|---|---|---|---|---|---|---|
| 1364120 | N/A | N/A | 8651 | 8670 | TGTGAATTCAGTACAAGAAT | 62 | 2137 |
| 1364122 | 2351 | 2370 | 18830 | 18849 | GTTTCTGCAAAGGCAGAATA | 83 | 2138 |
| 1364127 | 2703 | 2722 | 19182 | 19201 | GAACAACACAACTCTTTACA | 40 | 2139 |
| 1364148 | N/A | N/A | 4780 | 4799 | CACACATTACTCTGAGTAGA | 36 | 2140 |
| 1364190 | 1668 | 1687 | 18147 | 18166 | TGACCCCCTTCTCCCAGCTG | 49 | 2141 |
| 1364231 | 149 | 168 | 3859 | 3878 | TCTCTGAGTATCTTTGTCCT | 75 | 2142 |
| 1364241 | 2383 | 2402 | 18862 | 18881 | TACTCAAATTGAGATTCAAA | 54 | 2143 |

Example 3: Effect of Modified Oligonucleotides on Human PLP1 RNA In Vitro, Multiple Doses Modified oligonucleotides selected from the examples above were tested at various doses in SK-MEL-28 cells. Cultured SK-MEL-28 cells at a density of 20,000 cells per well were transfected using electroporation with concentrations of modified oligonucleotides as specified in the tables below. After a treatment period of approximately 24 hours, total RNA was isolated from the cells and PLP1 RNA levels were measured by quantitative real-time RTPCR. Human PLP1 primer probe set RTS35092 was used to measure RNA levels, as described above. PLP1 RNA levels were normalized to total RNA content, as measured by RIBOGREEN®. The modified oligonucleotides were tested in a series of experiments using the same culture conditions, and the results for each experiment are presented in separate tables below. Reduction of PLP1 RNA is presented in the tables below as percent PLP1 RNA relative to the amount in untreated control cells (% UTC).

The half maximal inhibitory concentration ($IC_{50}$) of each modified oligonucleotide was calculated using a linear regression on a log/linear plot of the data in Excel and is also presented in the tables below.

TABLE 29

Dose-dependent reduction of human PLP1 RNA in SK-MEL-28 cells by modified oligonucleotides

| Compound | PLP1 (% UTC) | | | | $IC_{50}$ |
|---|---|---|---|---|---|
| ID | 556 nM | 1667 nM | 5000 nM | 15000 nM | (μM) |
| 1218118 | 89 | 66 | 35 | 22 | 3.3 |
| 1218157 | 69 | 45 | 21 | 15 | 1.4 |
| 1218162 | 74 | 54 | 28 | 18 | 2.0 |
| 1218165 | 73 | 51 | 23 | 9 | 1.6 |
| 1218166 | 79 | 55 | 41 | 21 | 2.7 |
| 1218178 | 83 | 56 | 34 | 18 | 2.6 |
| 1218179 | 55 | 24 | 12 | 10 | <0.6 |
| 1218181 | 57 | 41 | 23 | 15 | 0.8 |
| 1218186 | 67 | 44 | 23 | 25 | 1.3 |
| 1218190 | 80 | 55 | 34 | 20 | 2.5 |
| 1218193 | 67 | 38 | 20 | 9 | 1.1 |
| 1218209 | 60 | 33 | 19 | 6 | 0.8 |
| 1218221 | 79 | 56 | 32 | 13 | 2.3 |
| 1218222 | 71 | 44 | 32 | 21 | 1.7 |
| 1218225 | 70 | 45 | 23 | 7 | 1.4 |

TABLE 29-continued

Dose-dependent reduction of human PLP1 RNA in SK-MEL-28 cells by modified oligonucleotides

| Compound | PLP1 (% UTC) | | | | $IC_{50}$ |
|---|---|---|---|---|---|
| ID | 556 nM | 1667 nM | 5000 nM | 15000 nM | (μM) |
| 1218226 | 78 | 53 | 29 | 17 | 2.1 |
| 1218229 | 70 | 44 | 21 | 9 | 1.4 |
| 1218233 | 82 | 61 | 31 | 13 | 2.5 |
| 1218354 | 71 | 43 | 22 | 18 | 1.4 |

TABLE 30

Dose-dependent reduction of human PLP1 RNA in SK-MEL-28 cells by modified oligonucleotides

| Compound | PLP1 (% UTC) | | | | $IC_{50}$ |
|---|---|---|---|---|---|
| ID | 556 nM | 1667 nM | 5000 nM | 15000 nM | (μM) |
| 1218163 | 61 | 31 | 13 | 7 | 0.8 |
| 1218168 | 69 | 46 | 26 | 18 | 1.5 |
| 1218175 | 64 | 36 | 22 | 14 | 1.0 |
| 1218180 | 72 | 52 | 25 | 15 | 1.8 |
| 1218188 | 72 | 45 | 29 | 24 | 1.7 |
| 1218191 | 75 | 51 | 26 | 13 | 1.8 |
| 1218192 | 75 | 47 | 23 | 11 | 1.7 |
| 1218203 | 74 | 50 | 22 | 7 | 1.6 |
| 1218204 | 50 | 57 | 31 | 31 | 1.0 |
| 1218208 | 63 | 34 | 17 | 10 | 0.9 |
| 1218209 | 61 | 33 | 27 | 10 | 0.8 |
| 1218215 | 75 | 47 | 17 | 5 | 1.5 |
| 1218216 | 68 | 47 | 36 | 18 | 1.7 |
| 1218219 | 61 | 31 | 19 | 8 | 0.8 |
| 1218220 | 85 | 65 | 37 | 16 | 3.0 |
| 1218223 | 60 | 34 | 23 | 10 | 0.8 |
| 1218228 | 67 | 44 | 22 | 13 | 1.3 |
| 1218355 | 75 | 46 | 21 | 9 | 1.6 |
| 1218387 | 62 | 33 | 21 | 19 | 0.8 |

TABLE 31

| Dose-dependent reduction of human PLP1 RNA in SK-MEL-28 cells by modified oligonucleotides | | | | | |
|---|---|---|---|---|---|
| Compound | PLP1 (% UTC) | | | | $IC_{50}$ |
| ID | 94 nM | 375 nM | 1500 nM | 6000 nM | (μM) |
| 1362449 | 107 | 88 | 67 | 28 | 2.5 |
| 1362490 | 82 | 45 | 21 | 10 | 0.4 |
| 1362496 | 81 | 49 | 21 | 11 | 0.4 |
| 1362641 | 92 | 65 | 30 | 14 | 0.8 |
| 1362987 | 89 | 78 | 43 | 29 | 1.4 |
| 1363103 | 123 | 81 | 35 | 10 | 1.2 |
| 1363134 | 75 | 57 | 26 | 10 | 0.5 |
| 1363184 | 104 | 78 | 59 | 16 | 1.5 |
| 1363410 | 100 | 66 | 27 | 12 | 0.8 |
| 1363439 | 91 | 63 | 40 | 21 | 0.9 |
| 1363641 | 80 | 48 | 18 | 10 | 0.4 |
| 1363734 | 80 | 59 | 19 | 14 | 0.5 |
| 1363736 | 90 | 73 | 39 | 12 | 0.9 |
| 1363900 | 91 | 58 | 25 | 8 | 0.6 |
| 1363959 | 84 | 65 | 34 | 15 | 0.7 |
| 1364007 | 78 | 59 | 27 | 12 | 0.5 |
| 1364235 | 109 | 86 | 41 | 14 | 1.3 |

TABLE 32

| Dose-dependent reduction of human PLP1 RNA in SK-MEL-28 cells by modified oligonucleotides | | | | | |
|---|---|---|---|---|---|
| Compound | PLP1 (% UTC) | | | | $IC_{50}$ |
| ID | 94 nM | 375 nM | 1500 nM | 6000 nM | (μM) |
| 1362468 | 90 | 67 | 24 | 6 | 0.6 |
| 1362490 | 83 | 41 | 13 | 5 | 0.3 |
| 1362500 | 106 | 83 | 43 | 10 | 1.2 |
| 1362900 | 115 | 78 | 30 | 6 | 1.0 |
| 1363141 | 99 | 63 | 31 | 13 | 0.8 |
| 1363257 | 118 | 82 | 40 | 12 | 1.2 |
| 1363493 | 139 | 93 | 48 | 9 | 1.5 |
| 1363550 | 72 | 54 | 21 | 5 | 0.4 |
| 1363565 | 88 | 52 | 29 | 14 | 0.6 |
| 1363644 | 103 | 91 | 36 | 12 | 1.2 |
| 1363758 | 84 | 49 | 16 | 5 | 0.4 |
| 1363983 | 74 | 71 | 30 | 9 | 0.6 |
| 1363993 | 78 | 60 | 36 | 10 | 0.6 |
| 1364066 | 103 | 78 | 34 | 8 | 1.0 |
| 1364073 | 107 | 82 | 56 | 17 | 1.5 |
| 1364246 | 125 | 70 | 17 | 11 | 0.9 |
| 1364248 | 80 | 62 | 30 | 9 | 0.6 |

TABLE 33

| Dose-dependent reduction of human PLP1 RNA in SK-MEL-28 cells by modified oligonucleotides | | | | | |
|---|---|---|---|---|---|
| Compound | PLP1 (% UTC) | | | | $IC_{50}$ |
| ID | 94 nM | 375 nM | 1500 nM | 6000 nM | (μM) |
| 1362445 | 72 | 55 | 24 | 8 | 0.4 |
| 1362490 | 69 | 33 | 11 | 4 | 0.2 |
| 1362556 | 81 | 58 | 30 | 14 | 0.6 |
| 1362612 | 86 | 79 | 56 | 26 | 1.6 |
| 1362649 | 92 | 64 | 37 | 10 | 0.8 |
| 1362924 | 87 | 80 | 55 | 26 | 1.7 |
| 1362996 | 79 | 62 | 32 | 8 | 0.6 |
| 1363013 | 103 | 67 | 38 | 15 | 1.0 |
| 1363019 | 79 | 59 | 20 | 6 | 0.5 |
| 1363143 | 74 | 47 | 16 | 5 | 0.3 |
| 1363146 | 110 | 101 | 59 | 24 | 2.2 |

TABLE 33-continued

| Dose-dependent reduction of human PLP1 RNA in SK-MEL-28 cells by modified oligonucleotides | | | | | |
|---|---|---|---|---|---|
| Compound | PLP1 (% UTC) | | | | $IC_{50}$ |
| ID | 94 nM | 375 nM | 1500 nM | 6000 nM | (μM) |
| 1363322 | 70 | 52 | 19 | 6 | 0.3 |
| 1363583 | 98 | 65 | 34 | 7 | 0.8 |
| 1364202 | 113 | 88 | 73 | 31 | 3.0 |

TABLE 34

| Dose-dependent reduction of human PLP1 RNA in SK-MEL-28 cells by modified oligonucleotides | | | | | |
|---|---|---|---|---|---|
| Compound | PLP1 (% UTC) | | | | $IC_{50}$ |
| ID | 94 nM | 375 nM | 1500 nM | 6000 nM | (μM) |
| 1362458 | 95 | 67 | 37 | 20 | 1.0 |
| 1362490 | 76 | 41 | 21 | 7 | 0.3 |
| 1362680 | 91 | 50 | 28 | 7 | 0.6 |
| 1362817 | 94 | 76 | 31 | 13 | 0.9 |
| 1362856 | 77 | 57 | 34 | 8 | 0.5 |
| 1363012 | 90 | 74 | 48 | 17 | 1.1 |
| 1363101 | 76 | 45 | 26 | 10 | 0.4 |
| 1363255 | 102 | 77 | 39 | 8 | 1.0 |
| 1363287 | 99 | 69 | 39 | 13 | 0.9 |
| 1363351 | 103 | 74 | 40 | 11 | 1.0 |
| 1363398 | 85 | 66 | 45 | 18 | 0.9 |
| 1363640 | 96 | 82 | 54 | 23 | 1.6 |
| 1363685 | 86 | 67 | 43 | 10 | 0.8 |
| 1363762 | 77 | 57 | 23 | 7 | 0.5 |
| 1363883 | 103 | 60 | 23 | 18 | 0.8 |
| 1364182 | 86 | 64 | 35 | 8 | 0.7 |
| 1364208 | 77 | 57 | 30 | 16 | 0.5 |

TABLE 35

| Dose-dependent reduction of human PLP1 RNA in SK-MEL-28 cells by modified oligonucleotides | | | | | |
|---|---|---|---|---|---|
| Compound | PLP1 (% UTC) | | | | $IC_{50}$ |
| ID | 94 nM | 375 nM | 1500 nM | 6000 nM | (μM) |
| 1362490 | 72 | 42 | 19 | 5 | 0.3 |
| 1362866 | 82 | 50 | 25 | 12 | 0.5 |
| 1362909 | 91 | 53 | 24 | 18 | 0.6 |
| 1363145 | 86 | 66 | 39 | 10 | 0.8 |
| 1363179 | 87 | 55 | 20 | 7 | 0.5 |
| 1363196 | 110 | 85 | 47 | 18 | 1.5 |
| 1363273 | 82 | 72 | 34 | 12 | 0.7 |
| 1363391 | 87 | 71 | 37 | 21 | 0.9 |
| 1363429 | 81 | 59 | 23 | 9 | 0.5 |
| 1363431 | 92 | 51 | 20 | 5 | 0.5 |
| 1363452 | 100 | 72 | 41 | 16 | 1.1 |
| 1363486 | 90 | 80 | 37 | 14 | 1.0 |
| 1363519 | 78 | 53 | 15 | 5 | 0.4 |
| 1363638 | 81 | 56 | 23 | 7 | 0.5 |
| 1363642 | 97 | 84 | 39 | 17 | 1.2 |
| 1363648 | 107 | 72 | 35 | 14 | 1.0 |
| 1363971 | 101 | 79 | 46 | 20 | 1.3 |
| 1364147 | 75 | 66 | 24 | 7 | 0.5 |

TABLE 36

Dose-dependent reduction of human PLP1 RNA in SK-MEL-28 cells by modified oligonucleotides

| Compound | PLP1 (% UTC) | | | | $IC_{50}$ |
|---|---|---|---|---|---|
| ID | 94 nM | 375 nM | 1500 nM | 6000 nM | (μM) |
| 1362473 | 93 | 73 | 28 | 8 | 0.8 |
| 1362490 | 80 | 48 | 15 | 6 | 0.4 |
| 1362517 | 78 | 42 | 12 | 3 | 0.3 |
| 1362602 | 80 | 68 | 20 | 8 | 0.5 |
| 1362689 | 90 | 61 | 28 | 8 | 0.6 |
| 1362724 | 112 | 78 | 46 | 12 | 1.2 |
| 1362774 | 93 | 70 | 41 | 11 | 0.9 |
| 1362805 | 94 | 85 | 38 | 11 | 1.0 |
| 1362928 | 84 | 69 | 26 | 10 | 0.7 |
| 1363191 | 91 | 48 | 18 | 6 | 0.5 |
| 1363544 | 87 | 50 | 17 | 4 | 0.4 |
| 1363591 | 74 | 50 | 19 | 6 | 0.4 |
| 1363673 | 89 | 70 | 32 | 13 | 0.8 |
| 1363889 | 81 | 38 | 12 | 4 | 0.3 |
| 1364107 | 84 | 55 | 23 | 9 | 0.5 |
| 1364116 | 78 | 56 | 15 | 6 | 0.4 |
| 1364257 | 83 | 62 | 16 | 15 | 0.5 |

TABLE 37

Dose-dependent reduction of human PLP1 RNA in SK-MEL-28 cells by modified oligonucleotides

| Compound | PLP1 (% UTC) | | | | $IC_{50}$ |
|---|---|---|---|---|---|
| ID | 94 nM | 375 nM | 1500 nM | 6000 nM | (μM) |
| 1362490 | 76 | 39 | 15 | 3 | 0.3 |
| 1362519 | 77 | 51 | 24 | 7 | 0.4 |
| 1362535 | 77 | 56 | 28 | 5 | 0.5 |
| 1362591 | 111 | 72 | 31 | 8 | 0.9 |
| 1362611 | 77 | 41 | 14 | 5 | 0.3 |
| 1362723 | 94 | 60 | 28 | 13 | 0.7 |
| 1362784 | 88 | 57 | 20 | 10 | 0.5 |
| 1362948 | 68 | 41 | 9 | 4 | 0.2 |
| 1363557 | 97 | 75 | 38 | 7 | 0.9 |
| 1363602 | 80 | 52 | 16 | 4 | 0.4 |
| 1363633 | 81 | 58 | 31 | 8 | 0.5 |
| 1363678 | 73 | 61 | 30 | 11 | 0.5 |
| 1364125 | 68 | 42 | 14 | 4 | 0.2 |
| 1363121 | 89 | 70 | 36 | 11 | 0.8 |

TABLE 38

Dose-dependent reduction of human PLP1 RNA in SK-MEL-28 cells by modified oligonucleotides

| Compound | PLP1 (% UTC) | | | | $IC_{50}$ |
|---|---|---|---|---|---|
| ID | 94 nM | 375 nM | 1500 nM | 6000 nM | (μM) |
| 1362490 | 86 | 54 | 18 | 8 | 0.5 |
| 1362497 | 110 | 86 | 50 | 18 | 1.5 |
| 1362712 | 77 | 46 | 21 | 13 | 0.4 |
| 1362892 | 91 | 86 | 56 | 30 | 2.2 |
| 1362970 | 91 | 61 | 26 | 10 | 0.7 |
| 1363102 | 91 | 85 | 45 | 20 | 1.3 |
| 1363392 | 77 | 53 | 26 | 14 | 0.5 |
| 1363393 | 74 | 72 | 37 | 13 | 0.7 |
| 1363517 | 97 | 81 | 36 | 18 | 1.1 |
| 1363696 | 77 | 52 | 26 | 13 | 0.5 |
| 1363701 | 89 | 75 | 49 | 21 | 1.2 |
| 1363850 | 102 | 76 | 36 | 13 | 1.0 |
| 1363121 | 76 | 48 | 22 | 8 | 0.4 |

TABLE 39

Dose-dependent reduction of human PLP1 RNA in SK-MEL-28 cells by modified oligonucleotides

| Compound | PLP1 (% UTC) | | | | $IC_{50}$ |
|---|---|---|---|---|---|
| ID | 94 nM | 375 nM | 1500 nM | 6000 nM | (μM) |
| 1362490 | 83 | 47 | 22 | 13 | 0.4 |
| 1362659 | 98 | 76 | 46 | 15 | 1.2 |
| 1362749 | 84 | 49 | 22 | 6 | 0.4 |
| 1362790 | 102 | 76 | 46 | 41 | 2.2 |
| 1362813 | 114 | 82 | 47 | 13 | 1.3 |
| 1362842 | 106 | 96 | 57 | 35 | 2.8 |
| 1362927 | 89 | 72 | 36 | 10 | 0.8 |
| 1363022 | 104 | 85 | 44 | 14 | 1.3 |
| 1363235 | 91 | 68 | 43 | 17 | 1.0 |
| 1363330 | 83 | 91 | 37 | 16 | 1.1 |
| 1363415 | 87 | 72 | 59 | 16 | 1.3 |
| 1363474 | 103 | 77 | 30 | 9 | 0.9 |
| 1363485 | 80 | 50 | 13 | 4 | 0.4 |
| 1363627 | 95 | 86 | 66 | 15 | 1.7 |
| 1363724 | 107 | 89 | 49 | 9 | 1.3 |
| 1363801 | 85 | 73 | 29 | 10 | 0.7 |
| 1363802 | 80 | 65 | 26 | 9 | 0.6 |
| 1363940 | 88 | 72 | 30 | 13 | 0.8 |

Example 4: Design of Modified Oligonucleotides Complementary to Human PLP1 Nucleic Acid Modified oligonucleotides complementary to a human PLP1 nucleic acid were designed, as described in the table below. "Start site" indicates the 5'-most nucleoside to which the modified oligonucleotide is complementary in the target nucleic acid sequence. "Stop site" indicates the 3'-most nucleoside to which the modified oligonucleotide is complementary in the target nucleic acid sequence. Each modified oligonucleotide listed in the tables below is 100% complementary to SEQ ID NO: 1 (described herein above), to SEQ ID NO: 2 (described herein above), or to both. 'N/A' indicates that the modified oligonucleotide is not 100% complementary to that particular target nucleic acid sequence.

The modified oligonucleotides in Table 40 are 6-10-4 MOE gapmers. The gapmers are 20 nucleosides in length, wherein the sugar motif for the gapmers is (from 5' to 3'): eeeeeeddddddddddeeee; wherein each 'd' represents a 2'-β-D-deoxyribosyl sugar moiety, and each 'e' represents a 2'-MOE sugar moiety. The gapmers have an internucleoside linkage motif of (from 5' to 3'): sooooossssssssssoss; wherein each "s" represents a phosphorothioate internucleoside linkage, and each "o" represents a phosphodiester internucleoside linkage. Each cytosine residue is a 5-methyl cytosine.

TABLE 40

6-10-4 MOE gapmers with mixed PO/PS internucleoside linkages complementary to human PLP1

| Compound ID | SEQ ID NO: 1 Start Site | SEQ ID NO: 1 Stop Site | SEQ ID NO: 2 Start Site | SEQ ID NO: 2 Stop Site | Sequence (5' to 3') | SEQ ID No. |
|---|---|---|---|---|---|---|
| 1523584 | 2225 | 2244 | 18704 | 18723 | TCTCCAGACATTTCTGATGC | 934 |
| 1523586 | 2227 | 2246 | 18706 | 18725 | ATTCTCCAGACATTTCTGAT | 2146 |
| 1523587 | 2228 | 2247 | 18707 | 18726 | TATTCTCCAGACATTTCTGA | 2147 |
| 1523588 | 2495 | 2514 | 18974 | 18993 | ATGTGATCTATATCAGGAGA | 1772 |
| 1523589 | 2496 | 2515 | 18975 | 18994 | TATGTGATCTATATCAGGAG | 2148 |
| 1523590 | 2497 | 2516 | 18976 | 18995 | TTATGTGATCTATATCAGGA | 1693 |
| 1523591 | 1996 | 2015 | 18475 | 18494 | AGAGGGCCATCTCAGGTTAC | 2149 |
| 1523592 | 1998 | 2017 | 18477 | 18496 | CCAGAGGGCCATCTCAGGTT | 993 |
| 1523593 | 1999 | 2018 | 18478 | 18497 | ACCAGAGGGCCATCTCAGGT | 881 |
| 1523594 | 3024 | 3043 | 19503 | 19522 | TTGCAATTCTATATCAGAAA | 2144 |
| 1523595 | 3025 | 3044 | 19504 | 19523 | ATTGCAATTCTATATCAGAA | 2010 |
| 1523596 | 2695 | 2714 | 19174 | 19193 | CAACTCTTTACAACAAAAGA | 630 |
| 1523597 | 2696 | 2715 | 19175 | 19194 | ACAACTCTTTACAACAAAAG | 556 |
| 1523598 | 2698 | 2717 | 19177 | 19196 | ACACAACTCTTTACAACAAA | 411 |
| 1523599 | 3028 | 3047 | 19507 | 19526 | AAAATTGCAATTCTATATCA | 1780 |
| 1523600 | 3029 | 3048 | 19508 | 19527 | TAAAATTGCAATTCTATATC | 1708 |
| 1523601 | 2667 | 2686 | 19146 | 19165 | ACAAATCTTTCCTTCAATTA | 682 |
| 1523602 | 2669 | 2688 | 19148 | 19167 | GTACAAATCTTTCCTTCAAT | 2150 |
| 1523603 | 2670 | 2689 | 19149 | 19168 | AGTACAAATCTTTCCTTCAA | 545 |
| 1523604 | N/A | N/A | 9198 | 9217 | AGATGTTCATCTCTTCACAA | 2151 |
| 1523605 | N/A | N/A | 9199 | 9218 | CAGATGTTCATCTCTTCACA | 1124 |
| 1523606 | N/A | N/A | 9200 | 9219 | TCAGATGTTCATCTCTTCAC | 2152 |
| 1523607 | N/A | N/A | 9201 | 9220 | ATCAGATGTTCATCTCTTCA | 2153 |
| 1523608 | N/A | N/A | 9202 | 9221 | CATCAGATGTTCATCTCTTC | 2145 |
| 1523609 | N/A | N/A | 9203 | 9222 | GCATCAGATGTTCATCTCTT | 1050 |
| 1523610 | 1382 | 1401 | 17861 | 17880 | CCTCCATTCCTTTGTGACTT | 1499 |
| 1523611 | 1383 | 1402 | 17862 | 17881 | GCCTCCATTCCTTTGTGACT | 1451 |
| 1523612 | 1384 | 1403 | 17863 | 17882 | AGCCTCCATTCCTTTGTGAC | 2154 |
| 1523613 | 1385 | 1404 | 17864 | 17883 | GAGCCTCCATTCCTTTGTGA | 2155 |

Example 5: Activity of Modified Oligonucleotides Complementary to Human PLP1 in Transgenic Mice Modified oligonucleotides selected from the examples above were tested in a human BAC wild type PLP1 transgenic mouse model. A bacterial artificial chromosome (BAC) subclone carrying the human Plp1 gene, including down- and up-stream regulatory elements was identified. Full gene sequencing confirmed the presence of the human genomic region corresponding to current NCBI refseq assembly GRCh38.p13, ChrX sequence NC_000023.11 at position 103776506 . . . 103792619. The BAC subclone was introduced via pronuclear injection into the Taconic Biosciences C57BL/6N Tac ES cell line. Line C57BL/6NTac-Tg (PLP1)1483Tac-17235 was generated and used in these experiments. Human Plp1 mRNA expression was found in the brain and spinal cord.

Treatment

The PLP1 transgenic mice were divided into groups of 2 mice each. Each mouse received a single intracerebroventricular (ICV) bolus of 100 μg of modified oligonucleotide. A group of 3-5 mice received PBS as a negative control.

RNA Analysis

Two weeks post treatment, mice were sacrificed and RNA was extracted from cortical brain tissue, spinal cord, and/or cerebellum for RTPCR analysis to measure the amount of PLP1 RNA using human primer probe set RTS48932 (forward sequence TGCACCAGTCATCAGCTATTC, designated herein as SEQ ID NO: 14; reverse sequence AGACTGAAATCTGGGAGCTATTC, designated herein as SEQ ID NO: 15; probe sequence AGGTCTCAAACTCTTTCTGCCTGTCC designated herein as SEQ ID NO: 16). Results are presented as percent human PLP1 RNA relative to PBS control, normalized to mouse GAPDH. GAPDH was amplified using primer probe set mGapdh_LTS00102 (forward sequence GGCAAATTCAACGGCACAGT, designated herein as SEQ ID NO: 17; reverse sequence GGGTCTCGCTCCTGGAAGAT, designated herein as SEQ ID NO: 18; probe sequence AAGGCCGAGAATGGGAAGCTTGTCATC, designated herein as SEQ ID NO: 19).

As shown in the tables below, treatment with modified oligonucleotides resulted in reduction of PLP1 RNA in comparison to the PBS control (% control).

TABLE 41

Reduction of human PLP1 RNA in transgenic mice by modified oligonucleotides

| Compound ID | PLP1 RNA (% control) Spinal Cord | Cortex |
|---|---|---|
| PBS | 100 | 100 |
| 1362445 | 43 | 50 |
| 1362473 | 69 | 71 |
| 1362556 | 63 | 66 |
| 1362712 | 25 | 36 |

TABLE 42

Reduction of human PLP1 RNA in transgenic mice by modified oligonucleotides

| Compound ID | PLP1 RNA (% control) Spinal Cord | Cortex |
|---|---|---|
| PBS | 100 | 100 |
| 1362445 | 22 | 50 |
| 1362449 | 43 | 61 |
| 1362458 | 27 | 33 |
| 1362468 | 33 | 59 |

TABLE 43

Reduction of human PLP1 RNA in transgenic mice by modified oligonucleotides

| Compound ID | PLP1 RNA (% control) Spinal Cord | Cortex | Cerebellum | Brain Stem | Hippocampus |
|---|---|---|---|---|---|
| PBS | 100 | 100 | 100 | 100 | 100 |
| 1362928 | 24 | 49 | 38 | 25 | 29 |
| 1363102 | 65 | 60 | 70 | 52 | 36 |
| 1363410 | 54 | 74 | 65 | 47 | 67 |

TABLE 43-continued

Reduction of human PLP1 RNA in transgenic mice by modified oligonucleotides

| Compound ID | PLP1 RNA (% control) Spinal Cord | Cortex | Cerebellum | Brain Stem | Hippocampus |
|---|---|---|---|---|---|
| 1363485 | 27 | 30 | 39 | 26 | 16 |
| 1363486 | 86 | 98 | 92 | 71 | 62 |
| 1363565 | 54 | 74 | 39 | 46 | 43 |

TABLE 44

Reduction of human PLP1 RNA in transgenic mice by modified oligonucleotides

| Compound ID | PLP1 RNA (% control) Spinal Cord | Cortex |
|---|---|---|
| PBS | 100 | 100 |
| 1362500 | 59 | 100 |
| 1362517 | 50 | 91 |
| 1362602 | 44 | 45 |
| 1362641 | 57 | 70 |
| 1362749 | 69 | 85 |
| 1362784 | 52 | 93 |
| 1362805 | 54 | 63 |
| 1362842 | 34 | 43 |
| 1362892 | 33 | 41 |
| 1362987 | 52 | 63 |
| 1362996 | 73 | 115 |

TABLE 45

Reduction of human PLP1 RNA in transgenic mice by modified oligonucleotides

| Compound ID | PLP1 RNA (% control) Spinal Cord | Cortex |
|---|---|---|
| PBS | 100 | 100 |
| 1362649 | 39 | 42 |
| 1363866 | 57 | 43 |
| 1363013 | 34 | 49 |
| 1363146 | 69 | 57 |

TABLE 46

Reduction of human PLP1 RNA in transgenic mice by modified oligonucleotides

| Compound ID | PLP1 RNA (% control) Spinal Cord | Cortex |
|---|---|---|
| PBS | 100 | 100 |
| 1363184 | 68 | 58 |
| 1363235 | 29 | 48 |
| 1363255 | 63 | 58 |
| 1363257 | 50 | 50 |
| 1363391 | 69 | 57 |
| 1363398 | 41 | 39 |

TABLE 46-continued

Reduction of human PLP1 RNA in transgenic mice by modified oligonucleotides

| Compound ID | PLP1 RNA (% control) Spinal Cord | Cortex |
|---|---|---|
| 1363429 | 70 | 48 |
| 1363452 | 81 | 57 |
| 1363493 | 80 | 56 |
| 1363544 | 53 | 92 |
| 1363550 | 79 | 82 |
| 1363557 | 49 | 34 |
| 1363583 | 93 | 69 |

TABLE 47

Reduction of human PLP1 RNA in transgenic mice by modified oligonucleotides

| Compound | PLP1 RNA (% control) | |
|---|---|---|
| ID | Spinal Cord | Cortex |
| PBS | 100 | 100 |
| 1362612 | 50 | 46 |
| 1363591 | 31 | 42 |
| 1363734 | 35 | 54 |
| 1363736 | 49 | 67 |
| 1363762 | 33 | 51 |
| 1363801 | 50 | 67 |
| 1363940 | 24 | 46 |
| 1363993 | 64 | 107 |
| 1364073 | 31 | 51 |
| 1364116 | 29 | 52 |
| 1364182 | 35 | 63 |
| 1523588 | 5 | 35 |
| 1523589 | 37 | 31 |
| 1523590 | 17 | 46 |
| 1523591 | 42 | 17 |
| 1523592 | 43 | 51 |
| 1523593 | 8 | 31 |
| 1523608 | 25 | 42 |

TABLE 48

Reduction of human PLP1 RNA in transgenic mice by modified oligonucleotides

| Compound ID | PLP1 RNA (% control) Spinal Cord | Cortex |
|---|---|---|
| PBS | 100 | 100 |
| 1523601 | 29 | 35 |
| 1523602 | 11 | 16 |
| 1523603 | 14 | 35 |
| 1523604 | 28 | 35 |
| 1523605 | 32 | 34 |
| 1523606 | 50 | 31 |
| 1523607 | 24 | 29 |
| 1523609 | 14 | 28 |
| 1523610 | 43 | 41 |
| 1523611 | 66 | 40 |
| 1523612 | 35 | 30 |

TABLE 49

Reduction of human PLP1 RNA in transgenic mice by modified oligonucleotides

| Compound ID | PLP1 RNA (% control) Spinal Cord | Cortex |
|---|---|---|
| PBS | 100 | 100 |
| 1363627 | 23 | 63 |
| 1523584 | 12 | 39 |
| 1523586 | 39 | 55 |
| 1523587 | 41 | 53 |
| 1523594 | 33 | 47 |
| 1523595 | 45 | 41 |
| 1523596 | 69 | 71 |
| 1523597 | 63 | 81 |
| 1523598 | 11 | 37 |
| 1523599 | 80 | 78 |
| 1523600 | 59 | 75 |
| 1523613 | 64 | 78 |

Example 6: Potency of Modified Oligonucleotides Complementary to Human PLP1 in Transgenic Mice Modified oligonucleotides selected from the examples above were tested in a human BAC wild type PLP1 transgenic mouse model (described herein above).

Treatment

The PLP1 transgenic mice were divided into groups of 4 mice each. Each mouse received a single intracerebroventricular (ICV) bolus of modified oligonucleotide at the doses indicated in the table below. A group of 4 mice received PBS as a negative control.

RNA Analysis

Two weeks post treatment, mice were sacrificed and RNA was extracted from spinal cord and cortical brain tissue for RTPCR analysis to measure the amount of PLP1 RNA using human primer probe sets RTS48932 (described herein above) and RTS48933 (forward sequence CCCTAACTCAGCCAACCTTAC, designated herein as SEQ ID NO: 5; reverse sequence CA(CCCTGTTTCTCTTCCCTAAC, designated herein as SEQ ID NO: 6; probe sequence AGGGAGCGTAGAATCTGTGTAGACGA, designated herein as SEQ ID NO: 7). Results are presented as percent human PLP1 RNA relative to PBS control, normalized to mouse GAPDH. GAPDH was amplified using primer probe set mGapdh_LTS00102 (described herein above).

Dose response and tissue concentration response data were analyzed using Microsoft Excel (v14.4) and GraphPad Prism software (v 8.2.0, San Diego, CA). $ED_{50}$ values were calculated from log transformed dose and individual animal Plp1 mRNA levels using custom equation Motulsky: Agonist vs response−Variable slope (four parameters) Y=Bottom+(Top−Bottom)/(1+(10^log EC50/X)^HillSlope), with the following constraints: bottom >0, top=100, HillSlope <−1 and >−2.

As shown in the table below, treatment with modified oligonucleotides resulted in dose-responsive reduction of PLP1 RNA in comparison to the PBS control.

TABLE 50

| Reduction of human PLP1 RNA in transgenic mice by modified oligonucleotides | | | | | | | | | |
|---|---|---|---|---|---|---|---|---|---|
| | | PLP1 RNA (% control) RTS48932 | | | | PLP1 RNA (% control) RTS48933 | | | |
| Compound ID | Dose (μg) | Spinal Cord | $ED_{50}$ (μg) | Cortex | $ED_{50}$ (μg) | Spinal Cord | $ED_{50}$ (μg) | Cortex | $ED_{50}$ (μg) |
| PBS | N/A | 100 | N/A | 100 | N/A | 100 | N/A | 100 | N/A |
| 1363235 | 10 | 101 | 86 | 92 | 65 | 102 | 82 | 96 | 60 |
| | 30 | 97 | | 70 | | 88 | | 68 | |
| | 100 | 44 | | 39 | | 45 | | 41 | |
| | 300 | 14 | | 15 | | 14 | | 16 | |
| 1523605 | 10 | 91 | 35 | 84 | 35 | 93 | 44 | 86 | 37 |
| | 30 | 55 | | 63 | | 57 | | 66 | |
| | 100 | 39 | | 29 | | 42 | | 30 | |
| | 300 | 17 | | 19 | | 17 | | 20 | |
| 1523608 | 10 | 92 | 33 | 91 | 76 | 97 | 37 | 92 | 73 |
| | 30 | 53 | | 65 | | 56 | | 66 | |
| | 100 | 30 | | 44 | | 31 | | 48 | |
| | 300 | 9 | | 14 | | 9 | | 15 | |

Example 7: Dose-Dependent Inhibition of Human PLP1 in SK-MEL-28 Cells by Modified Oligonucleotides Modified oligonucleotides selected from the examples above were tested at various doses in SK-MEL-28 cells (American Type Culture Collection). Cultured SK-MEL-28 cells at a density of 20,000 cells per well were transfected using electroporation with concentrations of modified oligonucleotides as specified in the tables below. After a treatment period of approximately 24 hours, total RNA was isolated from the cells and PLP1 RNA levels were measured by quantitative real-time RTPCR. PLP1 RNA levels were measured by quantitative real-time RTPCR using human primer-probe set RTS35092, described in Example 1 above. PLP1 RNA levels were normalized to human GAPDH, amplified using primer probe set RTS104 (forward sequence GAAGGTGAAGGTCGGAGTC, designated herein as SEQ ID NO: 8; reverse sequence GAAGATGGTGATGGGATTTC, designated herein as SEQ ID NO: 9; probe sequence CAAGCTTCCCGTTCTCAGCC, designated herein as SEQ ID NO: 10).

Reduction of PLP1 RNA is presented in the table below as percent PLP1 RNA relative to the amount in untreated control cells (% UTC). The half maximal inhibitory concentration ($IC_{50}$) of each modified oligonucleotide was calculated using GraphPad Prism 6 software and is also presented in the table below. $IC_{50}$ values were calculated from dose and PLP1 RNA levels by least squares fit to equation: log(inhibitor) vs. normalized response—Variable slope, Y=100/(1+10^((Log IC50−X)*HillSlope)).

TABLE 51

| Dose-dependent reduction of human PLP1 RNA in SK-MEL-28 cells by modified oligonucleotides | | | | | | | | | | | |
|---|---|---|---|---|---|---|---|---|---|---|---|
| | PLP1 RNA (% UTC) | | | | | | | | | | |
| Compound No. | 5.24 nM | 13.11 nM | 32.77 nM | 81.92 nM | 205 nM | 512 nM | 1280 nM | 3200 nM | 8000 nM | 20000 nM | $IC_{50}$ (μm) |
| 1363235 | 109 | 102 | 104 | 101 | 91 | 77 | 56 | 47 | 21 | 11 | 2.14 |
| 1523601 | 110 | 103 | 100 | 102 | 99 | 94 | 83 | 57 | 34 | 15 | 4.46 |
| 1523605 | 105 | 101 | 106 | 101 | 92 | 87 | 76 | 52 | 40 | 18 | 4.19 |
| 1523608 | 103 | 95 | 97 | 95 | 92 | 84 | 68 | 45 | 29 | 22 | 3.01 |

SEQUENCE LISTING (2168 sequences)

SEQ ID NO: 1 - RNA, 3152 nt, Homo sapiens
  source 1..3152: mol_type = mRNA
acttcatggcttctcacgcttgtgctgcatatcccacaccaattagacccaaggatcagttggaagtttccaggacatcttcattttatttccaccctcaatccacatttccagatgtctctgcagcaaagcgaaattccaggagaagaggacaaagatactcagagagaaaaagtaaaagaccgaagaaggaggctggagagaccaggatccttccagctgaacaaagtcagccacaaagcagactagccagccggctacaattggagtcagagtcccaaagacatgggcttgttagagtgctgtgcaagatgtctggtaggggccccctttgcttccctggtggccactggattgtgtttctttggggtggcactgttctgtggctgtggacatgaagccctcactggcacagaaaagctaattgagacctatttctccaaaaactaccaagactatgagtatctcatcaatgtgatccatgccttccagtatgtcatctatggaactgcctctttcttcttcctttatggggccctcctgctggctgagggcttctacaccaccggcgcagtcaggcagatctttggcgactacaagaccaccatctgcggcaagggcctgagcgcaacggtaacagggggccagaaggggaggggttccagaggccaacatcaagctcattctttggagcgggtgtgtcattgtttgggaaaatggctaggacatcccgacaagtttgtgggcatcacctatgccctgaccgttgtgtggctcctggtgtttgcctgctctgctgtgcctgtgtacatttacttcaacacctggaccacctgccagtctattgccttccccagcaagacctctgccagtataggcagtctctgtgctgatgccagaatgtatggtgttctcccatggaatgctttccctggcaaggtttgtggctccaaccttctgtccatctgcaaaacagctgagttccaaatgaccttccacctgtttattgctgcatttgtgggggctgcagctacactggtttccctgctcaccttcatgattgctgccacttacaactttgccgtccttaaactcatgggccgaggcaccaagttctgatcccccgtagaaatccccctttctctaatagcgaggctctaaccacacagcctacaatgctgcgtctcccatcttaactctttgcctttgccaccaactggccctcttcttacttgatgagtgtaacaagaaaggagagtcttgcagtgattaaggtctctctttggactctcccctcttatgtacctcttttagtcattttgcttcatagctggttcctgctagaaatgggaaatgcctaagaagatgacttcccaactgcaagtcacaaaggaatggaggctctaattgaattttcaagcatctcctgaggatcagaaagtaatttcttctcaaagggtacttccactgatggaaacaaagtggaaggaaagatgctcaggtacagagaaggaatgtctttggtcctcttgccatctataggggccaaatatattctctttggtgtacaaaatggaattcattctggtctctctattaccactgaagatagaagaaaaaagaatgtcagaaaaacaataagagcgtttgcccaaatctgcctattgcagctgggagaagggggtcaaagcaaggatctttcacccacagaaagagagcactgaccccgatggcgatggactactgaagccctaactcagccaaccttacttacagcataagggagcgtagaatctgtgtagacgaagggggcatctggccttacacctcgttagggaagagaaacagggtgttgtcagcatcttctcactcccttctccttgataacagctaccatgacaaccctgtggtttccaaggagctgagaatagaaggaaactagcttacatgagaacagactggcctgaggagcagcagttgctggtggctaatggtgtaacctgagatggccctctggtagacacaggatagataactctttggatagcatgtctttttttctgttaattagttgtgtactctggcctctgtcatatcttcacaatggtgctcatttcatggggtattatccattcagtcatcgtaggtgatttgaaggtcttgatttgttttagaatgatgcacatttcatgtattccagtttgtttattacttatttggggttgcatcagaaatgtctggagaataattctttgattatgactgttttttaaactaggaaaattggacattaagcatcacaaatgatattaaaaattggctagttgaatctattgggattttctacaagtattctgcctttgcagaaacagatttggtgaatttgaatctcaatttgagtaatctgatcgttctttctagctaatggaaaatgattttacttagcaatgttatcttggtgtgttaagagttaggtttaacataaaggttattttctcctgatatagatcacataacagaatgcaccagtcatcagctattcagttggtaagcttccaggaaaaaggacaggcagaaagagtttgagacctgaatagctcccagatttcagtcttttcctgtttttgttaactttgggttaaaaaaaaaaaaagtctgattggttttaattgaaggaaagatttgtactacagttcttttgttgtaaagagttgtgttgttcttttcccccaaagtggtttcagcaatatttaaggagatgtaagagctttacaaaaagacacttgatacttgttttcaaaccagtatacaagataagcttccaggctgcatagaaggaggagagggaaaatgttttgtaagaaaccaatcaagataaaggacagtgaagtaatccgtaccttgtgttttgttttgatttaataacataacaaataaccaacccttccctgaaaacctcacatgcatacatacacatatatacacacacaaagagagttaatcaactgaaagtgtttccttcatttctgatatagaattgcaattttaacacacataaaggataaacttttagaaacttatcttacaaagtgtattttataaaattaaagaaaataaaattaagaatgttctcaatcaaaaaaaaaaaaaaa

SEQ ID NO: 2 - DNA, 22000 bp, Homo sapiens
  source 1..22000: mol_type = genomic DNA
tcctcccccagcccccggctgttgttgctcagggcaaaggctctctattcacacattttttcacagcagaacaacctcccaagcaacttccaagcaataagagtctggagacaggcattctctagagatggctctggtctttgcttgctaggtgccattgggaaaattgtctcagtatcccatcagtcaaattgaacaaataacattggttccccagaaataatactagttttatttctactttgctcagaaatcacatcaaacaagcatcctccctgcaggggcaaccctgcaaaagctggccaagtttttatgttggtggaggtgggttctgtggacagcttgtttcttcacattgctagtagctatgtggtgctcctcaggcattctttagctgagatttttcatgtgattattttggcttccaggctactctttactccatcccaagccacgggcatctccccctcacaaatacaccccatggcctgcccctatccatcctcccattgttccttgaaccttcaggaaaggcagaagatcaccctccactctctacccctgtctgccagctcaaagtatgtgacatctctggccctcagccctcggttctcttggccagaaaggcatagtctagccaatcggcatgaagttgggtgtggaaagttctagccacagtacataggacataatatactgcctgcctgccagccagccagtcttctatgccagggctaggaaagctgccttccaaaatttggtctgggaagacattatcctgggaatgagaagcaaagcctcagctctagaagcccaaataatagcagatgacccaggctttcactggtacgcgcttctctcttcccctttatgttcttctctgtgctcagggagaagttggccactagattgggcacttgatcccttatctagtttttcctgggagaaattcactggacttctctgagttttagagttcagtctacacaatgaagcaaggagaacccacttgatctgtggccttcaataatctgatactatgggatcatagagcagagagtggaggtaatattcaagtgttttcgagttatttgcaagaaagctgcacagtcaaaccaagccatgatcaagggggcccagattctctgaggtaccatcagaattgcatgaagcaaactgtttacgagttttatacaatcctgcattgttcccacaggcacccagtacaggcagcaggctgcaccaagaaggctggcagtgcctcttgaggaatcccttggcagtgcaggagcctagctggactcaagaatattttgccaagggcacccagcagaaccaatggaagcagaatcacagaaataggtgggggtatgtagataaaaatgggctctggaggacctgggaagataccctatgaggtctgtagggagccctcaggaaaggtctgctgacgaggtactgaggcagagtgtcgggatgtacagagcaatgagaacacactagattctagggagttgggaaccttaaggcactgggatgagtgagacacggtcacctggctgggtcccttttctggccctgggcataagaacaagcataagaacaaggcgaagacagggaatgtggagagagaaaaaggaaacagagacagacacatagagagaaacagagacagagacaggtaacagagacaaagagattgagacttggggagaggatagaatgaatattaaggcaatggagatggaagaaaggagaagagaaatgtgtgttaagggaatgtggttgataaattggtatctgtgggtttattgggaacacatattttctttccagtagagttgctgtccccagagctgctgctgagaactcaggggaagctttgtgagagggctcagtctgagtgatgtcccctgtgtggagagctgtctcatctattcgagctgtgaaggatcatttgcctcatcctctaaatctgaactcccaaagtttgggctcactcctgccatctgatgagctgaggagacacatttggcgatttcttgctcttggtcctcccccttctccagggccattccgacagtgaccatccagaagtttattgctggctcaatcctacagttgagcttccaaagcaggcatagtctgtggctggcgagcagggctggggagggcgaggggctctaggacccttttccatcagtcacatggccttagtctcgtctgctctggaaagctactattataccgttttgcaaggggcagcatttccagagatccttttttcttggggctgatacaagagcaaaggatctagagttctagtactctaagcaagcctcaaacggtgcaggatttggccccagtgggcccacaggggcatctgccaaagactcgtccatttcctaacagcagagcccaagccagtaacatgtccaaagtcacagcccaaagagaaaactgtaagacacaatcttgcctttctcccaccccaggaaggtactagtctctgctcagtatctccctcctcttctctcctctcccaaggcaaaatcacaggaaaagttccaggagaccataccttccttctccggagtcttccaacaggtgcccctcttattatatgccagccagttgttttaaaggccatccatgggaggacaccggcctctaggtcaagggagctgtgaagggagacaggactgacaaggagcccagacagacactgtttaagattcacctgttctagaaaaccttcccaggctgatcccatctagcagtgggcatttaaataccttcacagtctttagaaatagcttattgctaaggcaggttttatatagtatttccctgtttttgctgcttagccatttttgtcttaccgcttctttctctgtggcaaggactatatttcgtttcttctctccaccctcactgccacctgctgcttcactctaacccactccctgcctcttgtctgcctggcttaagctctctgatgaagatattacactctcaggatagaatactgactacctgattcccagatcgtgttcttgacttgtctcgaagtcgattatccttcttggaaatcacccacatcttcaacgctggccttttctttaacctagtctgtgaacttgcataggtcttgcccacttctgggtctttattattgtagctataaaattattacaattctagcctcccccagcctaatcacaatctgttcatcgaattgacagcctgcattttgtcttcatgcagttgaaactgagaaggatttggaggaaattatcttaaaagacaattttttcttctctattgtgttcgtagagctgggggtgggggtgggggaggaacgcttattttccaaggaatcgggaggggaaaggtggagagggccaagggcagctaggagtgatgtggggagctggagcagattcggaaggactttgggagctaatatctaggtttttgactctgagcccctgttggggctctcacttcatggcttctcacgcttgtgctgcatatcccacaccaattagacccaaggatcagttggaagtttccaggacatcttcattttatttccaccctcaatccacatttccagatgtctctgcagcaaagcgaaattccaggcaagccttagggaaaaaaggaaaaacaaagaaaatgaaacaattggcagtgaaaggcagaaagagaagatggagcccttagagaagggagtatccctgagtaggtggggaaaaggggaggagaagggaggaggagaggaggaggaaagcaggcctgtccctttaagggggttggctgtcaatcagaaagcccttttcattgcaggagaagaggacaaagatactcagagagaaaaagtaaaagaccgaagaaggaggctggagagaccaggatccttccagctgaacaaagtcagccacaaagcagactagccagccggctacaattggagtcagagtcccaaagacatgggtaagtttcaaaaactttagcattgaagattcaagaggacacaggaattcacaagagaatttccaactttggggttcgggggttccatggtttaaatgagtcgtgttttggcacttgttttctttttaaattccttaacattcagttagattaactccttctccgctgtactaagcatgatgctttattaccaaagaattccagcagcacgtggagagtcccacagatctctggagagagtgcccagctggatggatgtggtcatgtgtcctcctaccccctcacttccctctatcttctcttttcccttggttccaaggccctggcaacggttgggtcagcttgccctcctggttctgctggaggccactgagcactgtctagccctcagatgtacaaaataactgcttgcttgatgcaaactttgaaccatgtttggcattaataggaagctggggatcgggcaagctggactcaggcttggctatggctgaggaggccattctcaggttcaggaaatgaaagtaaagtcctcaatggcttgaccatgggaaacagatatgggtaggagtgtgtgtgtgtatgtgcatatgtgcatgtgtgtgcacatatagggttgatcatttctagcaaatatcacagacacagctttcctgaaggctctttgctgtgacaaggaggatgctgggacattagggctcttgctaagttggctgagtattgagggcttttctaggttccgtgaacaaagacagaagctatgaagttctggtggtagtttctactcagagtaatgtgtgcagagcacaagggtctttgtccctattggactccacagagtcctgtagacattgctaacatttggcaaaacaaagatagcagcttaaacacatcctaaatgaaatgagactcagttgccccatgtattccctatcaaatgtagcatccagtagacaacatccacagagatcaatttgcaattatactgagctggttcagcctttaggttgtttcatcatgaaacacagagagaacactttgaagcatgtgttcaggtaaaacaggagggagagcactggacagggagtcggaaaaatcagattcaaatcccagatctgctacttatgaactatgtgaccttggacaggtcactgaatcaccacttcctcatctggaaaatggggacagcaataactactttgtctactttcagggttgtgagaatcaagtaacaataatgtcaaagtcctttgaaaatgggcaagatctataacaactgtaaatcatgataatacctactattagacaataatgtgtatacaggcgaactcttcctctttccagggtggttgggttttctttgcgtgcttgggtcagaatcatttgaccaattatgtgtgaccagatgagaggtgaatgttggaggaactcaattcctgccctgggtaacatcaggaatcctatctaatgtcagccgagctgactggataggttgtgcattaaaaacagagagggagtaaagaaggatgttgaatattacttcctcaggggatgaaatccctgaggaaaggcaggaacaaataaagtgaccacagggacaattgcctgttatggaggctgggtggtttcctccagaggaagagtgccacagataagggcacgattgaggatgcacattgggtcccaggtcctaagggtggacgatacttgggccaggtacatatgatggagcagccactgagttttcatttattcaataacagagtatctaaagtactttgaattatagatcatctctaacaaggtactggactgccactacttctgatgtggagtgcactgctgttcaacaattgcagtaaacacattgtatcatggaatccgggattggaaggaactttagaagttgtctgagccaaccttcaatgcgggattcatttttacaacaaccaattaaatgttcgtacagcctctgcttaatcacctccaggaacagggaacttactacttcaaccatatagaatcccttaggattggaagcaaggaggaacactgattcagtagtgtctgcacaaaagatttatggggaaaatgatagctcattaatttttgccttgatttggaaggggaatgttccaagtgagtctttgggataatgatggaaccagaaaggagcaaaagagcagtagctgattattctctgctctgaaacacaatgccattattgaacagcaaaacattgtctgcaagcctgttgtcgtctgagaacagtggctgttaccctggtaaccagactgtgatgcctccatccaaaagtggctgtttgccaagcagtgtagttttggctggcttgcagtaagtgggtgtagcccaggcaaaaagtgtggcggcagagcgggggtccagttttataaaatgcccgaagactaactgagtcccatcaaaatggcaagaatgccccaagaataccaggagccaaaaataaaccagatcccagccagcatgttcacctagtcttcctggagacactgactaaaataatcaagtgcagccttctctacctcacttctccctttggccgtgcagagccagaggagttcttggaaagccaggcagtttgaaaggtctaccctgctttagggggccttgggcttggctctgagctaggaaagccagaagtttacttaacaggctgacaactggaactgctctctcagagcgatctgagtaataacaacctcaaccctgggaggtgggtgggaggggaaatatagtctccaaacccattaaggtagaactccagccagtaacatcactttcccccattgcttttgtctatcgtcctgaagccttgaaagccatcccctgggtacaggtctttgtcttgaaagaaagcaacagtagaaatgccttccctgcccacagcacttcaggtctaaagaagaccaagtgaggacagtgacatgatcaggaagggtcacagcagccatggtaggtgaatggagcagcttttccttcctttcctgctttcagagcctactcagtgccaaacttacatcaaaagctcagcaagtactgattgattaatccctcttgcctacggcaaaatggccctgagggctatctctcagctctgcactggcctctgagctgtctgccaggcagggctctagaaaagagtcccaaggaagagaataaggttccccaaatcagcttcacactgcaacaaggagagaggaggaaatggtgggagactgacctgaggaacaaggtatggctactattgtctctagtaccagttacttccctttcatcttcccattcgtgggcaaggtggagacaatgtgccaaggataagttttaacaatcaaagtcctacctcagcttcccaatgcttgcacataaattggaatgtgtacatcattcattctgtctctctctgtgtgtgtgtgtgtgtgtgtgtgtgtgtgcgcgtctgaagaggagtggggagtataggaaacaagatagtccagatgctgttgccgtggtaatactaaatcgtgtccaaagaggaggctgagattcctttttagttaaccttgtccacatgatttgactatccagcaggcttggattcccaggccccagagacttcgggactgttttccagcacttgaatgtggtatataagtgctgatatcaaaagggatatgtaggaaagacaagattataggcagggcattgtctgaccaggacgaggcccgaagcaaaagtctttgtttgtctctggcacctcttgataattgttgttttactcctagaacccacccactgatccccatccatccctagtaccagtcacggctgctctagcatttcggccttgtcaactactgcaggccctgatcaaggaggcctctgttcatggggtaaggttaaggggtgggttctgggaggagggtaagactgtagtgcagattcgagacctagggaggtggggccagtttctcactcaatgagcctgcctgttgtttagctctattgtatagggttcttctatctctccctttgtcagctggattcaagggacaggctgggaattgtgcagggtacaattggtctctttctaccattcctttcgatgaaagcccttcctctccttcctttgatgagttcccagattcacactgaatttccatcatggagctggtccttgaggcgggcccagggcatgggaaaggagggagggagggttgggagctcttggtgcctgcttaaagagacagcatcaggatcaacacagtcccttgatgaacctggatctgtgtaagtcacattggttctgttgatctctgtcagaccgctgtgaagagcgctggtgagaagggcttaaagttggagtatcaactatcacagattgattagacttgttttgggagtttgtatacaaatgtagccaaccatgacatgatcttttccctttgcttacattttgcccacacaacttcgttatatccattttaacacttgcttataggtagctttagattttgattcacagacatatgtttgttcaccccaacaggatttcaagttttctaaagaaagggactggccttttaattcccttctgtttctcctaatgtctatgtcactgctagtgtgcttaattcttgtactgaattcacataaacagaaatgaaagaaaaacactggagggggtcattatttttctctatgacctttcatcaaagtcaggtggcttaatctgactgagttgcattgagaaatgttattactatatggttcttttatgccaactctctcatctcgcagtctgtacttagactggaaatgtgagaatgtctcttgagagagccaaggaacttctcccctagaatctcttccagccttcttgaatcaaactcacaccctttcaaccaggaggggttctgaaatggagagcttttggctttaggctattgttcacacatacccaagggacatttcttggactgtgaaaaatcaaagggagcccaatggatcttttctcagaatgctttgattgtcaactactttgatgaaaaaataatttcttgcaggctctgagtttttctcagttagaatctaaaatctgattcttgcttggacagactgactgagattcttcacttctgctgaacttaaatgcccccaaagcaaacatttcatctaggttgtgaagagatgaacatctgatgcttatgctgatattactgaattgtttatagcttaatagtgatagatttatctaaagtcatttatttcagactttacattagaaactcattaaagcctacttctttcttgtcccttgctttgagctgtagtggagcagaaaaggggatgctaagttattcaagttctaagaaaatagaggaaaaatggatgtaaaaagaaaggctatgatctggtgactcagaattgctcctaaggcttagccatttatcacccagtaagaacacaatccatgacactctcaggttatttggatgatgattgagggatcagatacactcaagaggatgtttccctctcatctttgcaaccctagaggtggcatcacctaacgcttaaagtggagttctcttttggctagcaagagttcaagttcctccatccctgaccatacctgcacaagcacttagcccttcccagatgaaaatgctgggatgagtgagtaggcccaagatggtcacttgctagggtggatggctcttcttaccctcggctaaacaaacagtcctgccattgttccctgagtctgaccccctccccaccccccggctgcaggcccctgtggaataccaatcaggctcctgagatctcaggaaagaacaaggcttctttgtccgggggagctatggagggctctgtccaagccctgaccctgtgctggggagaaagggaacagtggggtcactgaccttcttctccccccatccccaggcttcagagactttctttactagaaaagtctaagagtttgggggtggggaggagttggataggcagagaaggaaaatggcagtactgtttacttctaagctccttttcttgacttataggctgaatctagtatcttaacctgttgagaaagaggaagatcaatttctggaatgttttctgagaacaacaatcgatttcagttgttgtgtttttctctgtggtatacatgtgtgtatgtgcacatttgtacacatgcatgcatgtgcgtgtgcacacacacagacacacccatgggccagctctgaaaagacactcttcccaagcacgtttgcaaagttcatgctgagtaaactcagcctccactcacagcagcacagctacagattgcttcttatagaggccaagtttcctggcagcaatgctttagttcttggaaaaggaagttctgctccaaatgttagctgcttactttgtttggcttgggcttctgaggctcatctttggtgtgacactctttgaaggccaagaaagggctgtcatttcaggggatggtgggtaataggactcactccttttgtgtctctgagaacagaggcaaatgcctctacctcgattttcccatgacagagataatttgatctttccaaatctgttcacactgatgcaattcagccatgtaaatcactaggtattcatgctctctgggctaaaaacaaactgtaactaatgttaacagaatcaggaaaaggagtcccctttccctggtaccctatagaaaagtgagtgtggcttggagaaatgcttgaatacaaaaatccaagcctaagtaattaatacaatttatttttattgtacaagctgtcacaacctgcttattcaaaaatagcagcttcccagtacatttgctgagtatttgtgtgtgtgcatgtgtatactgtgtttatagatatataaaatcagtgggtatatatacatatatttatatatatacatacatatgaattaagacattttttctgaagagcttaacattctcatttcttctacattttagggatctggccgagaggccagaggaagccattcttttcctcatctagtcagtcatctacttggcatttgctaaggttcactccatatgacatcttagagcatgggactagtacttggaacacagctgctttcagagcctgtgacttcttgtgtgcctctcctgtttctcagcaacactggcatagggcctgggataccaggtctggggatctcagggactcttagcactttaagacacatgtgttcccaggccctggtgtgttcctctagtgccagaaagatgtttcatgctttgctgactttgtataaagtctgtttgtagctgttttgacagaatctcagcgtataactgagggtggggacattagccaagctgcattataggaggacaaaactgccatacaaagtgtccaaaatcattaagcctgcatttttattattgggagtaatatcaaacctcctattttccaattttcatttcttgtcctgtgctagctccatcctgtttggactgctcctcccatatgtaaactaagaagaatcaagcattctttgcaacaaatacacacgatgctcaaaaatgtccaggagcatccaatttccaaagtttcctccacctggaatgctcttcatgctaaaatcctgtctgacaataccagcatctctggcctgcactcatcccttcctggaactccaagtgcatttaccctctgttaccacttacttggctgcctgaattgttagttgaaaatattaggtctacttagctaattcttcctcaggaaattaaagactcccatatggcagagtctgtgtcttttctctcttcatatcccgtataacacccagcataatgctgggcatatagtgagtattccataaatagttgatgaatgactaaaataagcaagcaaacaaacagactagaacaataagaaagaagggactgatttcataatctctctggcttgctatttgaattgctgaattattattatttattaaatattttttaaattctggcaataaaaggtaaggatttattttctttctttctttttttttttcttgagacagagtctcgctcttactgcccaggctggagtacaatggcgcaatcttggctcacggcaacctccgcctcctcctgggtttaacagattctcctgtctcagcctcctgagtagctgggattacaggcatacgcccatgcccggctaatttttgtatttttagtagagacggggttttgccatgttggccaggctggtcttgaactcctgacctcatgtgatccacctgcctcagcctcccaaagtgctgggattacaggcatgagccaccgtgcccggccaaagatttattttcaagaatgaaacaaagtaaggattctgggtcaatctcacatgctgaaagccaaaacctctagccgctcctgctttttgacttcggagtgcccactatctccgagcctgtgagcacagggcctggcagaggggtttgagtggcatgagctacctactggatgtgcctgactgtttccccttcttcttccccaggcttgttagagtgctgtgcaagatgtctggtaggggccccctttgcttccctggtggccactggattgtgtttctttggggtggcactgttctgtggctgtggacatgaagccctcactggcacagaaaagctaattgagacctatttctccaaaaactaccaagactatgagtatctcatcaatgtgtaagtacctgccctcccacacagacccatcttttttttccctctctccatcctggagatagagaactcttcagtaccttagtaactagcaggggactggggtggagccagaccggattcccgagtcttccctctgtgcagatctctcctgctccacattcgaagcccattcagaaaggaggggtctgcctgcctgcctgtcagcccctcccacccccgcccccttgttttcttacacgtgttctgacttctgctaggtgtggttcatattgcccaagttggagcctccagcgtagtaggtatggagaagccaagggaggcactaagcctctcctgttcctagaacaagttaggctcctgttccttcacccacctttcttcttgtctagctccctactcctgtgagttagcatgtctgaagggtggggcagggagagtaggtccctggttctccaggtcccagggtaagcaaggtgtggcgggaggggcatatgtttctggtcacatacaccctgtcttcacttatttcaacaaagataaggtgaaagcatgcaggaggaacctggtgattcctctagaaaatccctagccttgttaaggtgctcgctctggtgtatacctcacttatgtcgggaaagaagccaggtcttcaattaataagattccctggtctcgtttgtctacctgttaatgcaggatccatgccttccagtatgtcatctatggaactgcctctttcttcttcctttatggggccctcctgctggctgagggcttctacaccaccggcgcagtcaggcagatctttggcgactacaagaccaccatctgcggcaagggcctgagcgcaacggtaacagggggccagaaggggaggggttccagaggccaacatcaagctcattctttggagcgggtgtgtcattgtttgggaaaatggctaggacatcccgacaaggtgatcatcctcaggattttgtggcaataacaaggggtgggggaaaattgggcgcgagtctgtggcctcgtccccacccaaggctgggtcctctctaggggcctggcatttgagtgaggaagcgatggctgcagccgaacgagaaggtcaggaagaacgtggtgcccagctggcttagcctcacctttcaaaggttccctaagcaaatttcttctcaaaacagaaagcatgagttttgtgggatgctttgtacaatcagaccatttctaagccatctgttggtatccctttgttcccttcctagtaggtaccacaagagtggatctaactggacaagagtctaaaatgctgctcatgtgattgagacttgggcacctgatctgagagggaggatggataataaaaattaaataattaactccaaggtgaaatttacaatgttctgggatcctgcacagttcgaggtcccagagggaattggagtagatctgcatgttgaatgttttattgcctgagggttatccatgctttgagtgaggtgcacatttgttttcagtctctggagttaaagatcctttggcggctgaacatgtgtgggttccagcaatgtctttttgtggccagcagttagcttagaaaggttttgtatctgaaattttaatctcctattggctttgttcaatggctagggaacaaaaatgttcctatggcaaggaacatgttctaagctcagcctaaggcacaaaatggcacgactttctttcaagatctgttttgatttctttacaccttatctgcccaaaaacatcctctgaagcctctctaacccagggatcctcctcactcttcccctacccattccccccaccctccgttatactggggccagttatctagtagatactgccaattacccttggcagaggtgccctgctcactaatttcatttgaaggagagccctggaacctggttttaatgtctggcacacgccactccaggatctcccagtttgtgtttctacatctgcaggctgatgctgatttctaaccaccccatgtcaatcattttagtttgtgggcatcacctatgccctgaccgttgtgtggctcctggtgtttgcctgctctgctgtgcctgtgtacatttacttcaacacctggaccacctgccagtctattgccttccccagcaagacctctgccagtataggcagtctctgtgctgatgccagaatgtatggtgagttagggtacgggtgctttggctctcctacccactatggaagcactatatatttggttattttcttagtgtaaggagggtggtgattatgagaaaaatataagatgatgaatgattgggtcttagtttattaatccttccctactgaaaccagagaggtttcttccccgggaagggaacttggaagtggtgggagttttcttggccattcacattggcctactctagttgactgctgttcacaaccccaaagcagcacatttcaataacaaacacaaggtttcaccactgttcaataccaccttctcttttttgtaaacctgtagaaaagaggatcctgattgttggtagaatccaactttacagccaggataattagagatggaagaagggctctgggggaaagtctccatgtggccccgtaactccataaagcttaccctgcttgctttttgtgtcttacttaggtgttctcccatggaatgctttccctggcaaggtttgtggctccaaccttctgtccatctgcaaaacagctgaggtgagtgggttatttgggttattttacaagggagtagctaataccatacaaattacacccatggccttcaattttaaggactgaaagtttccctttgctggattttgaattagccgattgccttctacaacatgttggctaagtgtgcctgagccaatgagcatagaaggtaaaacacctgttttctctagagttgcatagaaagacttcctttccaacccttcccctcttaaaagagaagtttgtagctttaggtaaagatagagcctaatggcaaaatcccccacatgaaaattttcattcctttagttaaaaaccatatcaagaaaatgggctgtgcacagaggcattcataggttttatgaaaacattttcaatttggaacttctttatctcaaatgagaggtaaaataagtacatttgaaagggaaagcactgtattgagaacagatattatatacaaatgaggcaggggaataaaagtaaatccgggggagacaggcagtaaattatttctttgacagcaaaatgttgactttaaattttgggcccctgggcacaactgtagggaaccagttaattattttggagtactgtactatttcatgactattctgtgatctgggtgttaatgggccaggtgctatggtgtacactgaagactgggaggcccacatttagggaagtgaaaacttagttagagatgtggaattagcacacaagaaagatatcaacacattcagaaagctgtattcatgatttacagtggagcatattactgctgttgcaagaaacagttcttcctctttcattttcctgcagttccaaatgaccttccacctgtttattgctgcatttgtgggggctgcagctacactggtttccctggtgagttgactttgaatgatcttggcaagtaaataggcctgagatagtgtgggtacagctattctgaaaggcaagaaggtagactgcttccatccttgaaatgctggagggaagcttctgggaagatagcaaagggtggaggctccgtacttctacttgcattggcaaggcagaaagacatcacaaattagatgggaacaagaaaagtggtatgaggaaagaggtaagagattcatagacacgaatgataatatttagtatttatagaacatgtaatgttgccaagtactttgcagtcataaattacggttaattctcaatacattttgatcagatcagtgacaaaacactgaaacatcacgaaacatgacttgctatagcctggaattctatatactatcaatatgaatccactttggatactctccagtggatttagttactcatatggaaatactgggaggacctcctaacattattagaattgttatgattataatacaatgctatgtcccaggtcttgctgatagtgctacagtgccctgtgaatgtagtgtgctcattgtgcagattaaaaacctaaggcactgaagggtgaagtgatttatctgaagttattttataagcagtgatcagacaagatgagctcacagaactcctggcccctactgctgaggtttccatacagagtcaagtaatttctcaccttgtaaaacgaattgattcattaaccaggggagagctctactgcatgatgtggctgtgtgtctacagcaagcaccctatgactctaagtcactcggacatattgatgtggcaaagcccaaatattgttcacttccctgaggaaaactcagtgctagatcaaacagaggtgtggaataaatctttatgatttgattctctgggcctgggccatgagacccatgatgcctcagagacatcggacttccagtcaagtgtatatggagaaagccaagcctgggatgtactgctttttgcagagcatgggtttttcccttatttagttatgattttatttctacccttcctcattcccaaagggatttgaggagggagtgctttcttttctactctcattcacattctctcttctgttccctacagctcaccttcatgattgctgccacttacaactttgccgtccttaaactcatgggccgaggcaccaagttctgatcccccgtagaaatccccctttctctaatagcgaggctctaaccacacagcctacaatgctgcgtctcccatcttaactctttgcctttgccaccaactggccctcttcttacttgatgagtgtaacaagaaaggagagtcttgcagtgattaaggtctctctttggactctcccctcttatgtacctcttttagtcattttgcttcatagctggttcctgctagaaatgggaaatgcctaagaagatgacttcccaactgcaagtcacaaaggaatggaggctctaattgaattttcaagcatctcctgaggatcagaaagtaatttcttctcaaagggtacttccactgatggaaacaaagtggaaggaaagatgctcaggtacagagaaggaatgtctttggtcctcttgccatctataggggccaaatatattctctttggtgtacaaaatggaattcattctggtctctctattaccactgaagatagaagaaaaaagaatgtcagaaaaacaataagagcgtttgcccaaatctgcctattgcagctgggagaagggggtcaaagcaaggatctttcacccacagaaagagagcactgaccccgatggcgatggactactgaagccctaactcagccaaccttacttacagcataagggagcgtagaatctgtgtagacgaagggggcatctggccttacacctcgttagggaagagaaacagggtgttgtcagcatcttctcactcccttctccttgataacagctaccatgacaaccctgtggtttccaaggagctgagaatagaaggaaactagcttacatgagaacagactggcctgaggagcagcagttgctggtggctaatggtgtaacctgagatggccctctggtagacacaggatagataactctttggatagcatgtctttttttctgttaattagttgtgtactctggcctctgtcatatcttcacaatggtgctcatttcatggggtattatccattcagtcatcgtaggtgatttgaaggtcttgatttgttttagaatgatgcacatttcatgtattccagtttgtttattacttatttggggttgcatcagaaatgtctggagaataattctttgattatgactgttttttaaactaggaaaattggacattaagcatcacaaatgatattaaaaattggctagttgaatctattgggattttctacaagtattctgcctttgcagaaacagatttggtgaatttgaatctcaatttgagtaatctgatcgttctttctagctaatggaaaatgattttacttagcaatgttatcttggtgtgttaagagttaggtttaacataaaggttattttctcctgatatagatcacataacagaatgcaccagtcatcagctattcagttggtaagcttccaggaaaaaggacaggcagaaagagtttgagacctgaatagctcccagatttcagtcttttcctgtttttgttaactttgggttaaaaaaaaaaaaagtctgattggttttaattgaaggaaagatttgtactacagttcttttgttgtaaagagttgtgttgttcttttcccccaaagtggtttcagcaatatttaaggagatgtaagagctttacaaaaagacacttgatacttgttttcaaaccagtatacaagataagcttccaggctgcatagaaggaggagagggaaaatgttttgtaagaaaccaatcaagataaaggacagtgaagtaatccgtaccttgtgttttgttttgatttaataacataacaaataaccaacccttccctgaaaacctcacatgcatacatacacatatatacacacacaaagagagttaatcaactgaaagtgtttccttcatttctgatatagaattgcaattttaacacacataaaggataaacttttagaaacttatcttacaaagtgtattttataaaattaaagaaaataaaattaagaatgttctcaatcaaacatcgtgtcctttgagtgaattgttctatttgacttcacaatagaaacttaataatcgtaccttgttcaaggagatcattcatttttcagctcatccaagtcattctcataacatttctctgaaataaatagtatatgaatagattacttctacttttatagttgaagacactaagaaatagaagcaaagtaatttgcccaaagaaatccagtaagtacatgtctgagcttgtgttaaaacgcagatattgaaaccaatttattgcctacttaaaggtttcttttctcttcgaagttgggtttcagaatgttcagagtcaactatggttactttttcaataccttagtggtgccccagtccccggtgcatttagatttaagttattgttaccttctctttaaattgtttggatattccagtaatgatcccttagtaattcatacgtgactaatatttagttttatttggatagtactggatggaaggtttagtacttaaaggacagagcaggtatggaaagggcaacgtaaatgtaaacaggctgtggcagggcagtactaaaataaattagtgacacctaccaccctggatggccagcctactagcccaccggggacatagcattaaagccctttcacaaccctaggttagaatttggcacccttggacagcactctgatgaccagcttaaagaaagctgtcttaaaatcatttcattgccccatagttgcagctggcaaatgactggagagaaaggaatctttagctggagggatgacaagtcagtcatcagttaaggagctccattcaaaagcagtttcaatttaatttcctgatttctgcttaaccacaattaatattctgcaagcgagtctggttgaacgactttaagacataaagaataaaaatatgacagggacttattttaagacactgcaaacaaggacacagcaccatattttggagaattgattcagggttctacagagtgattgtatttttgcctcagaggaaccgaaagccagttcccaagaaagctatgttttccatctgcccttatttggctctgcctctgggatgaatctatagatggagtttctaggctctcagaagctgagagcatctccagtctatcaattgaacccattgttcttagctctcccacacaccataaacctccttttttctaactgaaagagctctctttgtgctgagatcagccgaagatcaagatgcagcagtataaacaagaaacattttcttacagcaccagttgtattgcttttcctatcttcagggtcagtactgagtgcagttatgcaggacgtggaagctgcagctttgtccagagcaacatttgttcattccttaattcgttctgtgaacattcattgagaaactactaagtattgtgttaaaccccaggaagttcaagtttgggggcagtgtgggtagaaaggtgatcaagaccagatcttacactcaaggatctctctcagattcagccatagcagacaggtcttccacggtaaactggagtggaggcaaggagtgtgcaaaaggcagtctgatcggctgactccagtgggcatctgaattctcccctcagtatgtgggaggggtgggtgttaagggccttgacttcacgtggctctgggtttttagggcatggatacaaacaaaacttcaatttagagtcctgacaacttgtgacttgctctttctgtgtcaccctgcttcttgccttacatgtgacagcatttatgcacacactggctcaatgcatgtgcgtgcttccacccactcaatcatttggggagtcagagggcacatgaatcaagattgatataaacacaagctattcagtctggccttttgtctctatccaggctaagtctgagaagccaaggaagggtaatgtaagatataacatatcaaaactgcacttgtatcccctaaatttatacaacaacaacaaaaaagataccaagtccttctctgtttggatttccttaactgtgaacacaggtagtgtggctattttgacattaacagttaacttcatgaatattaagtaacaaataaaagaaatactcattattatatttacgaaatcaatacttggccattcctacatcaataagcaggtaaggacttcaagtcaatatttatatattgggaaagattttcctcgttcactcacttgtttgaaagacgcaaacatactcttcattatatttgttgtcccacaaagtttggtgtctatgtgctcctgttctgagactccttgaattgattgactttattctaaaggaaaatatcagataaggtaatgagtgttttactgattatggatcagtccaaagaaatccagtcttaa

SEQ ID NO: 3-4 - skipped (2 entries)

SEQ ID NO: 5 - DNA, 21 bp, synthetic construct
  source 1..21: mol_type = other DNA
ccctaactcagccaaccttac

SEQ ID NO: 6 - DNA, 22 bp, synthetic construct
  source 1..22: mol_type = other DNA
caccctgtttctcttccctaac

SEQ ID NO: 7 - DNA, 26 bp, synthetic construct
  source 1..26: mol_type = other DNA
agggagcgtagaatctgtgtagacga

SEQ ID NO: 8 - DNA, 19 bp, synthetic construct
  source 1..19: mol_type = other DNA
gaaggtgaaggtcggagtc

SEQ ID NO: 9 - DNA, 20 bp, synthetic construct
  source 1..20: mol_type = other DNA
gaagatggtgatgggatttc

SEQ ID NO: 10 - DNA, 20 bp, synthetic construct
  source 1..20: mol_type = other DNA
caagcttcccgttctcagcc

SEQ ID NO: 11 - DNA, 22 bp, synthetic construct
  source 1..22: mol_type = other DNA
ctgatgccagaatgtatggtgt

SEQ ID NO: 12 - DNA, 21 bp, synthetic construct
  source 1..21: mol_type = other DNA
aggtggaaggtcatttggaac

SEQ ID NO: 13 - DNA, 24 bp, synthetic construct
  source 1..24: mol_type = other DNA
tgcagatggacagaaggttggagc

SEQ ID NO: 14 - DNA, 21 bp, synthetic construct
  source 1..21: mol_type = other DNA
tgcaccagtcatcagctattc

SEQ ID NO: 15 - DNA, 23 bp, synthetic construct
  source 1..23: mol_type = other DNA
agactgaaatctgggagctattc

SEQ ID NO: 16 - DNA, 26 bp, synthetic construct
  source 1..26: mol_type = other DNA
aggtctcaaactctttctgcctgtcc

SEQ ID NO: 17 - DNA, 20 bp, synthetic construct
  source 1..20: mol_type = other DNA
ggcaaattcaacggcacagt

SEQ ID NO: 18 - DNA, 20 bp, synthetic construct
  source 1..20: mol_type = other DNA
gggtctcgctcctggaagat

SEQ ID NO: 19 - DNA, 27 bp, synthetic construct
  source 1..27: mol_type = other DNA
aaggccgagaatgggaagcttgtcatc

SEQ ID NO: 20 - DNA, 20 bp, synthetic construct
  source 1..20: mol_type = other DNA
agccaacccccttaaaggga

SEQ ID NO: 21 - DNA, 20 bp, synthetic construct
  source 1..20: mol_type = other DNA
tctgattgacagccaacccc

SEQ ID NO: 22 - DNA, 20 bp, synthetic construct
  source 1..20: mol_type = other DNA
ccggctggctagtctgcttt

SEQ ID NO: 23 - DNA, 20 bp, synthetic construct
  source 1..20: mol_type = other DNA
tccaattgtagccggctggc

SEQ ID NO: 24 - DNA, 20 bp, synthetic construct
  source 1..20: mol_type = other DNA
ccctaccagacatcttgcac

SEQ ID NO: 25 - DNA, 20 bp, synthetic construct
  source 1..20: mol_type = other DNA
gccggtggtgtagaagccct

SEQ ID NO: 26 - DNA, 20 bp, synthetic construct
  source 1..20: mol_type = other DNA
tctgcctgactgcgccggtg

SEQ ID NO: 27 - DNA, 20 bp, synthetic construct
  source 1..20: mol_type = other DNA
tagtcgccaaagatctgcct

SEQ ID NO: 28 - DNA, 20 bp, synthetic construct
  source 1..20: mol_type = other DNA
atggtggtcttgtagtcgcc

SEQ ID NO: 29 - DNA, 20 bp, synthetic construct
  source 1..20: mol_type = other DNA
ccttgccgcagatggtggtc

SEQ ID NO: 30 - DNA, 20 bp, synthetic construct
  source 1..20: mol_type = other DNA
aggcccttgccgcagatggt

SEQ ID NO: 31 - DNA, 20 bp, synthetic construct
  source 1..20: mol_type = other DNA
cgttgcgctcaggcccttgc

SEQ ID NO: 32 - DNA, 20 bp, synthetic construct
  source 1..20: mol_type = other DNA
tgttaccgttgcgctcaggc

SEQ ID NO: 33 - DNA, 20 bp, synthetic construct
  source 1..20: mol_type = other DNA
cccctgttaccgttgcgctc

SEQ ID NO: 34 - DNA, 20 bp, synthetic construct
  source 1..20: mol_type = other DNA
atgttggcctctggaacccc

SEQ ID NO: 35 - DNA, 20 bp, synthetic construct
  source 1..20: mol_type = other DNA
acaatgacacacccgctcca

SEQ ID NO: 36 - DNA, 20 bp, synthetic construct
  source 1..20: mol_type = other DNA
tgtcgggatgtcctagccat

SEQ ID NO: 37 - DNA, 20 bp, synthetic construct
  source 1..20: mol_type = other DNA
agccacacaacggtcagggc

SEQ ID NO: 38 - DNA, 20 bp, synthetic construct
  source 1..20: mol_type = other DNA
ggtggtccaggtgttgaagt

SEQ ID NO: 39 - DNA, 20 bp, synthetic construct
  source 1..20: mol_type = other DNA
gcattccatgggagaacacc

SEQ ID NO: 40 - DNA, 20 bp, synthetic construct
  source 1..20: mol_type = other DNA
cagaacttggtgcctcggcc

SEQ ID NO: 41 - DNA, 20 bp, synthetic construct
  source 1..20: mol_type = other DNA
gggatcagaacttggtgcct

SEQ ID NO: 42 - DNA, 20 bp, synthetic construct
  source 1..20: mol_type = other DNA
gctgtgtggttagagcctcg

SEQ ID NO: 43 - DNA, 20 bp, synthetic construct
  source 1..20: mol_type = other DNA
ggagacgcagcattgtaggc

SEQ ID NO: 44 - DNA, 20 bp, synthetic construct
  source 1..20: mol_type = other DNA
ggcccctatagatggcaaga

SEQ ID NO: 45 - DNA, 20 bp, synthetic construct
  source 1..20: mol_type = other DNA
cagtagtccatcgccatcgg

SEQ ID NO: 46 - DNA, 20 bp, synthetic construct
  source 1..20: mol_type = other DNA
agggcttcagtagtccatcg

SEQ ID NO: 47 - DNA, 20 bp, synthetic construct
  source 1..20: mol_type = other DNA
ggttggctgagttagggctt

SEQ ID NO: 48 - DNA, 20 bp, synthetic construct
  source 1..20: mol_type = other DNA
ccttatgctgtaagtaaggt

SEQ ID NO: 49 - DNA, 20 bp, synthetic construct
  source 1..20: mol_type = other DNA
acgctcccttatgctgtaag

SEQ ID NO: 50 - DNA, 20 bp, synthetic construct
  source 1..20: mol_type = other DNA
ttctacgctcccttatgctg

SEQ ID NO: 51 - DNA, 20 bp, synthetic construct
  source 1..20: mol_type = other DNA
tacacagattctacgctccc

SEQ ID NO: 52 - DNA, 20 bp, synthetic construct
  source 1..20: mol_type = other DNA
tgtaaggccagatgccccct

SEQ ID NO: 53 - DNA, 20 bp, synthetic construct
  source 1..20: mol_type = other DNA
tctcttccctaacgaggtgt

SEQ ID NO: 54 - DNA, 20 bp, synthetic construct
  source 1..20: mol_type = other DNA
aggttacaccattagccacc

SEQ ID NO: 55 - DNA, 20 bp, synthetic construct
  source 1..20: mol_type = other DNA
gtgtctaccagagggccatc

SEQ ID NO: 56 - DNA, 20 bp, synthetic construct
  source 1..20: mol_type = other DNA
ccaatagattcaactagcca

SEQ ID NO: 57 - DNA, 20 bp, synthetic construct
  source 1..20: mol_type = other DNA
ggagctattcaggtctcaaa

SEQ ID NO: 58 - DNA, 20 bp, synthetic construct
  source 1..20: mol_type = other DNA
tacggattacttcactgtcc

SEQ ID NO: 59 - DNA, 20 bp, synthetic construct
  source 1..20: mol_type = other DNA
acacaaggtacggattactt

SEQ ID NO: 60 - DNA, 20 bp, synthetic construct
  source 1..20: mol_type = other DNA
tccttgggtctaattggtgt

SEQ ID NO: 61 - DNA, 20 bp, synthetic construct
  source 1..20: mol_type = other DNA
tcgctttgctgcagagacat

SEQ ID NO: 62 - DNA, 20 bp, synthetic construct
  source 1..20: mol_type = other DNA
tgggcccccttgatcatggc

SEQ ID NO: 63 - DNA, 20 bp, synthetic construct
  source 1..20: mol_type = other DNA
gctccctacagacctcatag

SEQ ID NO: 64 - DNA, 20 bp, synthetic construct
  source 1..20: mol_type = other DNA
ggtcctagagcccctcgccc

SEQ ID NO: 65 - DNA, 20 bp, synthetic construct
  source 1..20: mol_type = other DNA
cctgccttagcaataagcta

SEQ ID NO: 66 - DNA, 20 bp, synthetic construct
  source 1..20: mol_type = other DNA
aacctagatattagctccca

SEQ ID NO: 67 - DNA, 20 bp, synthetic construct
  source 1..20: mol_type = other DNA
gcccgatccccagcttccta

SEQ ID NO: 68 - DNA, 20 bp, synthetic construct
  source 1..20: mol_type = other DNA
gttgttatagatcttgccca

SEQ ID NO: 69 - DNA, 20 bp, synthetic construct
  source 1..20: mol_type = other DNA
tgcacaacctatccagtcag

SEQ ID NO: 70 - DNA, 20 bp, synthetic construct
  source 1..20: mol_type = other DNA
ccaatcccggattccatgat

SEQ ID NO: 71 - DNA, 20 bp, synthetic construct
  source 1..20: mol_type = other DNA
gttgaagtagtaagttccct

SEQ ID NO: 72 - DNA, 20 bp, synthetic construct
  source 1..20: mol_type = other DNA
gccgccacactttttgcctg

SEQ ID NO: 73 - DNA, 20 bp, synthetic construct
  source 1..20: mol_type = other DNA
agggccattttgccgtaggc

SEQ ID NO: 74 - DNA, 20 bp, synthetic construct
  source 1..20: mol_type = other DNA
cgatttagtattaccacggc

SEQ ID NO: 75 - DNA, 20 bp, synthetic construct
  source 1..20: mol_type = other DNA
gatatcagcacttatatacc

SEQ ID NO: 76 - DNA, 20 bp, synthetic construct
  source 1..20: mol_type = other DNA
accaattgtaccctgcacaa

SEQ ID NO: 77 - DNA, 20 bp, synthetic construct
  source 1..20: mol_type = other DNA
ttaagcccttctcaccagcg

SEQ ID NO: 78 - DNA, 20 bp, synthetic construct
  source 1..20: mol_type = other DNA
ccattgggctccctttgatt

SEQ ID NO: 79 - DNA, 20 bp, synthetic construct
  source 1..20: mol_type = other DNA
gtgcttgtgcaggtatggtc

SEQ ID NO: 80 - DNA, 20 bp, synthetic construct
  source 1..20: mol_type = other DNA
tccaccctagcaagtgacca

SEQ ID NO: 81 - DNA, 20 bp, synthetic construct
  source 1..20: mol_type = other DNA
gagtcctattacccaccatc

SEQ ID NO: 82 - DNA, 20 bp, synthetic construct
  source 1..20: mol_type = other DNA
aggagtgagtcctattaccc

SEQ ID NO: 83 - DNA, 20 bp, synthetic construct
  source 1..20: mol_type = other DNA
ccctcagttatacgctgaga

SEQ ID NO: 84 - DNA, 20 bp, synthetic construct
  source 1..20: mol_type = other DNA
aggaggtttgatattactcc

SEQ ID NO: 85 - DNA, 20 bp, synthetic construct
  source 1..20: mol_type = other DNA
accttgcttaccctgggacc

SEQ ID NO: 86 - DNA, 20 bp, synthetic construct
  source 1..20: mol_type = other DNA
accttgtcgggatgtcctag

SEQ ID NO: 87 - DNA, 20 bp, synthetic construct
  source 1..20: mol_type = other DNA
actcgcgcccaattttcccc

SEQ ID NO: 88 - DNA, 20 bp, synthetic construct
  source 1..20: mol_type = other DNA
cgaggccacagactcgcgcc

SEQ ID NO: 89 - DNA, 20 bp, synthetic construct
  source 1..20: mol_type = other DNA
ccagttagatccactcttgt

SEQ ID NO: 90 - DNA, 20 bp, synthetic construct
  source 1..20: mol_type = other DNA
ggtgcccaagtctcaatcac

SEQ ID NO: 91 - DNA, 20 bp, synthetic construct
  source 1..20: mol_type = other DNA
tctactagataactggcccc

SEQ ID NO: 92 - DNA, 20 bp, synthetic construct
  source 1..20: mol_type = other DNA
cccgtaccctaactcaccat

SEQ ID NO: 93 - DNA, 20 bp, synthetic construct
  source 1..20: mol_type = other DNA
ggtattagctactcccttgt

SEQ ID NO: 94 - DNA, 20 bp, synthetic construct
  source 1..20: mol_type = other DNA
ccattaggctctatctttac

SEQ ID NO: 95 - DNA, 20 bp, synthetic construct
  source 1..20: mol_type = other DNA
tcagtgtacaccatagcacc

SEQ ID NO: 96 - DNA, 20 bp, synthetic construct
  source 1..20: mol_type = other DNA
aagtacggagcctccaccct

SEQ ID NO: 97 - DNA, 20 bp, synthetic construct
  source 1..20: mol_type = other DNA
cagtagagctctcccctggt

SEQ ID NO: 98 - DNA, 20 bp, synthetic construct
  source 1..20: mol_type = other DNA
cagccaacccccttaaaggg

SEQ ID NO: 99 - DNA, 20 bp, synthetic construct
  source 1..20: mol_type = other DNA
ttctgattgacagccaaccc

SEQ ID NO: 100 - DNA, 20 bp, synthetic construct
  source 1..20: mol_type = other DNA
tagccggctggctagtctgc

SEQ ID NO: 101 - DNA, 20 bp, synthetic construct
  source 1..20: mol_type = other DNA
actccaattgtagccggctg

SEQ ID NO: 102 - DNA, 20 bp, synthetic construct
  source 1..20: mol_type = other DNA
gcccctaccagacatcttgc

SEQ ID NO: 103 - DNA, 20 bp, synthetic construct
  source 1..20: mol_type = other DNA
gactgcgccggtggtgtaga

SEQ ID NO: 104 - DNA, 20 bp, synthetic construct
  source 1..20: mol_type = other DNA
gatctgcctgactgcgccgg

SEQ ID NO: 105 - DNA, 20 bp, synthetic construct
  source 1..20: mol_type = other DNA
gtagtcgccaaagatctgcc

SEQ ID NO: 106 - DNA, 20 bp, synthetic construct
  source 1..20: mol_type = other DNA
gatggtggtcttgtagtcgc

SEQ ID NO: 107 - DNA, 20 bp, synthetic construct
  source 1..20: mol_type = other DNA
cccttgccgcagatggtggt

SEQ ID NO: 108 - DNA, 20 bp, synthetic construct
  source 1..20: mol_type = other DNA
cgctcaggcccttgccgcag

SEQ ID NO: 109 - DNA, 20 bp, synthetic construct
  source 1..20: mol_type = other DNA
taccgttgcgctcaggccct

SEQ ID NO: 110 - DNA, 20 bp, synthetic construct
  source 1..20: mol_type = other DNA
ctgttaccgttgcgctcagg

SEQ ID NO: 111 - DNA, 20 bp, synthetic construct
  source 1..20: mol_type = other DNA
ccccctgttaccgttgcgct

SEQ ID NO: 112 - DNA, 20 bp, synthetic construct
  source 1..20: mol_type = other DNA
gatgttggcctctggaaccc

SEQ ID NO: 113 - DNA, 20 bp, synthetic construct
  source 1..20: mol_type = other DNA
ccaaacaatgacacacccgc

SEQ ID NO: 114 - DNA, 20 bp, synthetic construct
  source 1..20: mol_type = other DNA
ttgtcgggatgtcctagcca

SEQ ID NO: 115 - DNA, 20 bp, synthetic construct
  source 1..20: mol_type = other DNA
ggagccacacaacggtcagg

SEQ ID NO: 116 - DNA, 20 bp, synthetic construct
  source 1..20: mol_type = other DNA
gcctatactggcagaggtct

SEQ ID NO: 117 - DNA, 20 bp, synthetic construct
  source 1..20: mol_type = other DNA
ccatgagtttaaggacggca

SEQ ID NO: 118 - DNA, 20 bp, synthetic construct
  source 1..20: mol_type = other DNA
tcagaacttggtgcctcggc

SEQ ID NO: 119 - DNA, 20 bp, synthetic construct
  source 1..20: mol_type = other DNA
ggttagagcctcgctattag

SEQ ID NO: 120 - DNA, 20 bp, synthetic construct
  source 1..20: mol_type = other DNA
cgcagcattgtaggctgtgt

SEQ ID NO: 121 - DNA, 20 bp, synthetic construct
  source 1..20: mol_type = other DNA
gagttaagatgggagacgca

SEQ ID NO: 122 - DNA, 20 bp, synthetic construct
  source 1..20: mol_type = other DNA
tttggcccctatagatggca

SEQ ID NO: 123 - DNA, 20 bp, synthetic construct
  source 1..20: mol_type = other DNA
tcagtagtccatcgccatcg

SEQ ID NO: 124 - DNA, 20 bp, synthetic construct
  source 1..20: mol_type = other DNA
gttagggcttcagtagtcca

SEQ ID NO: 125 - DNA, 20 bp, synthetic construct
  source 1..20: mol_type = other DNA
gctgtaagtaaggttggctg

SEQ ID NO: 126 - DNA, 20 bp, synthetic construct
  source 1..20: mol_type = other DNA
cccttatgctgtaagtaagg

SEQ ID NO: 127 - DNA, 20 bp, synthetic construct
  source 1..20: mol_type = other DNA
tacgctcccttatgctgtaa

SEQ ID NO: 128 - DNA, 20 bp, synthetic construct
  source 1..20: mol_type = other DNA
cagattctacgctcccttat

SEQ ID NO: 129 - DNA, 20 bp, synthetic construct
  source 1..20: mol_type = other DNA
ctacacagattctacgctcc

SEQ ID NO: 130 - DNA, 20 bp, synthetic construct
  source 1..20: mol_type = other DNA
gtgtaaggccagatgccccc

SEQ ID NO: 131 - DNA, 20 bp, synthetic construct
  source 1..20: mol_type = other DNA
ttctcttccctaacgaggtg

SEQ ID NO: 132 - DNA, 20 bp, synthetic construct
  source 1..20: mol_type = other DNA
tcaggttacaccattagcca

SEQ ID NO: 133 - DNA, 20 bp, synthetic construct
  source 1..20: mol_type = other DNA
tgtgtctaccagagggccat

SEQ ID NO: 134 - DNA, 20 bp, synthetic construct
  source 1..20: mol_type = other DNA
cccaatagattcaactagcc

SEQ ID NO: 135 - DNA, 20 bp, synthetic construct
  source 1..20: mol_type = other DNA
gggagctattcaggtctcaa

SEQ ID NO: 136 - DNA, 20 bp, synthetic construct
  source 1..20: mol_type = other DNA
gtacggattacttcactgtc

SEQ ID NO: 137 - DNA, 20 bp, synthetic construct
  source 1..20: mol_type = other DNA
tgggatatgcagcacaagcg

SEQ ID NO: 138 - DNA, 20 bp, synthetic construct
  source 1..20: mol_type = other DNA
atccttgggtctaattggtg

SEQ ID NO: 139 - DNA, 20 bp, synthetic construct
  source 1..20: mol_type = other DNA
ggaatttcgctttgctgcag

SEQ ID NO: 140 - DNA, 20 bp, synthetic construct
  source 1..20: mol_type = other DNA
ctgggcccccttgatcatgg

SEQ ID NO: 141 - DNA, 20 bp, synthetic construct
  source 1..20: mol_type = other DNA
gctctgtacatcccgacact

SEQ ID NO: 142 - DNA, 20 bp, synthetic construct
  source 1..20: mol_type = other DNA
ctgccccttgcaaaacggta

SEQ ID NO: 143 - DNA, 20 bp, synthetic construct
  source 1..20: mol_type = other DNA
aggtagtcagtattctatcc

SEQ ID NO: 144 - DNA, 20 bp, synthetic construct
  source 1..20: mol_type = other DNA
gcctggaatttcgctttgct

SEQ ID NO: 145 - DNA, 20 bp, synthetic construct
  source 1..20: mol_type = other DNA
agcttgcccgatccccagct

SEQ ID NO: 146 - DNA, 20 bp, synthetic construct
  source 1..20: mol_type = other DNA
agttgttatagatcttgccc

SEQ ID NO: 147 - DNA, 20 bp, synthetic construct
  source 1..20: mol_type = other DNA
cgtgcccttatctgtggcac

SEQ ID NO: 148 - DNA, 20 bp, synthetic construct
  source 1..20: mol_type = other DNA
aagttccttccaatcccgga

SEQ ID NO: 149 - DNA, 20 bp, synthetic construct
  source 1..20: mol_type = other DNA
gcttgcagacaatgttttgc

SEQ ID NO: 150 - DNA, 20 bp, synthetic construct
  source 1..20: mol_type = other DNA
actcagttagtcttcgggca

SEQ ID NO: 151 - DNA, 20 bp, synthetic construct
  source 1..20: mol_type = other DNA
gggactcttttctagagccc

SEQ ID NO: 152 - DNA, 20 bp, synthetic construct
  source 1..20: mol_type = other DNA
gacacgatttagtattacca

SEQ ID NO: 153 - DNA, 20 bp, synthetic construct
  source 1..20: mol_type = other DNA
gcagtagttgacaaggccga

SEQ ID NO: 154 - DNA, 20 bp, synthetic construct
  source 1..20: mol_type = other DNA
agaccaattgtaccctgcac

SEQ ID NO: 155 - DNA, 20 bp, synthetic construct
  source 1..20: mol_type = other DNA
gatactccaactttaagccc

SEQ ID NO: 156 - DNA, 20 bp, synthetic construct
  source 1..20: mol_type = other DNA
gagtcaccagatcatagcct

SEQ ID NO: 157 - DNA, 20 bp, synthetic construct
  source 1..20: mol_type = other DNA
ttgggcctactcactcatcc

SEQ ID NO: 158 - DNA, 20 bp, synthetic construct
  source 1..20: mol_type = other DNA
gcaggactgtttgtttagcc

SEQ ID NO: 159 - DNA, 20 bp, synthetic construct
  source 1..20: mol_type = other DNA
tgagtcctattacccaccat

SEQ ID NO: 160 - DNA, 20 bp, synthetic construct
  source 1..20: mol_type = other DNA
cctctcggccagatccctaa

SEQ ID NO: 161 - DNA, 20 bp, synthetic construct
  source 1..20: mol_type = other DNA
agcttggctaatgtccccac

SEQ ID NO: 162 - DNA, 20 bp, synthetic construct
  source 1..20: mol_type = other DNA
cgggaatccggtctggctcc

SEQ ID NO: 163 - DNA, 20 bp, synthetic construct
  source 1..20: mol_type = other DNA
acaccttgcttaccctggga

SEQ ID NO: 164 - DNA, 20 bp, synthetic construct
  source 1..20: mol_type = other DNA
gaggatgatcaccttgtcgg

SEQ ID NO: 165 - DNA, 20 bp, synthetic construct
  source 1..20: mol_type = other DNA
gactcgcgcccaattttccc

SEQ ID NO: 166 - DNA, 20 bp, synthetic construct
  source 1..20: mol_type = other DNA
ggacgaggccacagactcgc

SEQ ID NO: 167 - DNA, 20 bp, synthetic construct
  source 1..20: mol_type = other DNA
gtccagttagatccactctt

SEQ ID NO: 168 - DNA, 20 bp, synthetic construct
  source 1..20: mol_type = other DNA
cctctgggacctcgaactgt

SEQ ID NO: 169 - DNA, 20 bp, synthetic construct
  source 1..20: mol_type = other DNA
ggtgatgcccacaaactaaa

SEQ ID NO: 170 - DNA, 20 bp, synthetic construct
  source 1..20: mol_type = other DNA
acccgtaccctaactcacca

SEQ ID NO: 171 - DNA, 20 bp, synthetic construct
  source 1..20: mol_type = other DNA
gtatggtattagctactccc

SEQ ID NO: 172 - DNA, 20 bp, synthetic construct
  source 1..20: mol_type = other DNA
ccccggatttacttttattc

SEQ ID NO: 173 - DNA, 20 bp, synthetic construct
  source 1..20: mol_type = other DNA
gtcttcagtgtacaccatag

SEQ ID NO: 174 - DNA, 20 bp, synthetic construct
  source 1..20: mol_type = other DNA
accgtaatttatgactgcaa

SEQ ID NO: 175 - DNA, 20 bp, synthetic construct
  source 1..20: mol_type = other DNA
tccgagtgacttagagtcat

SEQ ID NO: 176 - DNA, 20 bp, synthetic construct
  source 1..20: mol_type = other DNA
tgattgacagccaaccccct

SEQ ID NO: 177 - DNA, 20 bp, synthetic construct
  source 1..20: mol_type = other DNA
gctggctagtctgctttgtg

SEQ ID NO: 178 - DNA, 20 bp, synthetic construct
  source 1..20: mol_type = other DNA
ttgtagccggctggctagtc

SEQ ID NO: 179 - DNA, 20 bp, synthetic construct
  source 1..20: mol_type = other DNA
gactccaattgtagccggct

SEQ ID NO: 180 - DNA, 20 bp, synthetic construct
  source 1..20: mol_type = other DNA
gggcccctaccagacatctt

SEQ ID NO: 181 - DNA, 20 bp, synthetic construct
  source 1..20: mol_type = other DNA
gcctgactgcgccggtggtg

SEQ ID NO: 182 - DNA, 20 bp, synthetic construct
  source 1..20: mol_type = other DNA
gtcgccaaagatctgcctga

SEQ ID NO: 183 - DNA, 20 bp, synthetic construct
  source 1..20: mol_type = other DNA
ggtcttgtagtcgccaaaga

SEQ ID NO: 184 - DNA, 20 bp, synthetic construct
  source 1..20: mol_type = other DNA
gcagatggtggtcttgtagt

SEQ ID NO: 185 - DNA, 20 bp, synthetic construct
  source 1..20: mol_type = other DNA
gcccttgccgcagatggtgg

SEQ ID NO: 186 - DNA, 20 bp, synthetic construct
  source 1..20: mol_type = other DNA
gcgctcaggcccttgccgca

SEQ ID NO: 187 - DNA, 20 bp, synthetic construct
  source 1..20: mol_type = other DNA
ttaccgttgcgctcaggccc

SEQ ID NO: 188 - DNA, 20 bp, synthetic construct
  source 1..20: mol_type = other DNA
cctgttaccgttgcgctcag

SEQ ID NO: 189 - DNA, 20 bp, synthetic construct
  source 1..20: mol_type = other DNA
ctggccccctgttaccgttg

SEQ ID NO: 190 - DNA, 20 bp, synthetic construct
  source 1..20: mol_type = other DNA
ccgctccaaagaatgagctt

SEQ ID NO: 191 - DNA, 20 bp, synthetic construct
  source 1..20: mol_type = other DNA
cgggatgtcctagccatttt

SEQ ID NO: 192 - DNA, 20 bp, synthetic construct
  source 1..20: mol_type = other DNA
gcataggtgatgcccacaaa

SEQ ID NO: 193 - DNA, 20 bp, synthetic construct
  source 1..20: mol_type = other DNA
ccaggagccacacaacggtc

SEQ ID NO: 194 - DNA, 20 bp, synthetic construct
  source 1..20: mol_type = other DNA
tgcctatactggcagaggtc

SEQ ID NO: 195 - DNA, 20 bp, synthetic construct
  source 1..20: mol_type = other DNA
ggtgcctcggcccatgagtt

SEQ ID NO: 196 - DNA, 20 bp, synthetic construct
  source 1..20: mol_type = other DNA
gatcagaacttggtgcctcg

SEQ ID NO: 197 - DNA, 20 bp, synthetic construct
  source 1..20: mol_type = other DNA
gtgtggttagagcctcgcta

SEQ ID NO: 198 - DNA, 20 bp, synthetic construct
  source 1..20: mol_type = other DNA
acgcagcattgtaggctgtg

SEQ ID NO: 199 - DNA, 20 bp, synthetic construct
  source 1..20: mol_type = other DNA
agtggaagtaccctttgaga

SEQ ID NO: 200 - DNA, 20 bp, synthetic construct
  source 1..20: mol_type = other DNA
tgcaataggcagatttgggc

SEQ ID NO: 201 - DNA, 20 bp, synthetic construct
  source 1..20: mol_type = other DNA
gcttcagtagtccatcgcca

SEQ ID NO: 202 - DNA, 20 bp, synthetic construct
  source 1..20: mol_type = other DNA
agttagggcttcagtagtcc

SEQ ID NO: 203 - DNA, 20 bp, synthetic construct
  source 1..20: mol_type = other DNA
tgctgtaagtaaggttggct

SEQ ID NO: 204 - DNA, 20 bp, synthetic construct
  source 1..20: mol_type = other DNA
gctcccttatgctgtaagta

SEQ ID NO: 205 - DNA, 20 bp, synthetic construct
  source 1..20: mol_type = other DNA
ctacgctcccttatgctgta

SEQ ID NO: 206 - DNA, 20 bp, synthetic construct
  source 1..20: mol_type = other DNA
acagattctacgctccctta

SEQ ID NO: 207 - DNA, 20 bp, synthetic construct
  source 1..20: mol_type = other DNA
tctacacagattctacgctc

SEQ ID NO: 208 - DNA, 20 bp, synthetic construct
  source 1..20: mol_type = other DNA
ggtgtaaggccagatgcccc

SEQ ID NO: 209 - DNA, 20 bp, synthetic construct
  source 1..20: mol_type = other DNA
ggttgtcatggtagctgtta

SEQ ID NO: 210 - DNA, 20 bp, synthetic construct
  source 1..20: mol_type = other DNA
ctcaggttacaccattagcc

SEQ ID NO: 211 - DNA, 20 bp, synthetic construct
  source 1..20: mol_type = other DNA
gactgaatggataatacccc

SEQ ID NO: 212 - DNA, 20 bp, synthetic construct
  source 1..20: mol_type = other DNA
gatgactggtgcattctgtt

SEQ ID NO: 213 - DNA, 20 bp, synthetic construct
  source 1..20: mol_type = other DNA
cggattacttcactgtcctt

SEQ ID NO: 214 - DNA, 20 bp, synthetic construct
  source 1..20: mol_type = other DNA
ggtacggattacttcactgt

SEQ ID NO: 215 - DNA, 20 bp, synthetic construct
  source 1..20: mol_type = other DNA
ggtgtgggatatgcagcaca

SEQ ID NO: 216 - DNA, 20 bp, synthetic construct
  source 1..20: mol_type = other DNA
gatccttgggtctaattggt

SEQ ID NO: 217 - DNA, 20 bp, synthetic construct
  source 1..20: mol_type = other DNA
aagtgcccaatctagtggcc

SEQ ID NO: 218 - DNA, 20 bp, synthetic construct
  source 1..20: mol_type = other DNA
atctacatacccccacctat

SEQ ID NO: 219 - DNA, 20 bp, synthetic construct
  source 1..20: mol_type = other DNA
ggtgaccgtgtctcactcat

SEQ ID NO: 220 - DNA, 20 bp, synthetic construct
  source 1..20: mol_type = other DNA
tactagaactctagatcctt

SEQ ID NO: 221 - DNA, 20 bp, synthetic construct
  source 1..20: mol_type = other DNA
ccaagaaggataatcgactt

SEQ ID NO: 222 - DNA, 20 bp, synthetic construct
  source 1..20: mol_type = other DNA
cgactcatttaaaccatgga

SEQ ID NO: 223 - DNA, 20 bp, synthetic construct
  source 1..20: mol_type = other DNA
ccagctcagtataattgcaa

SEQ ID NO: 224 - DNA, 20 bp, synthetic construct
  source 1..20: mol_type = other DNA
taggattcctgatgttaccc

SEQ ID NO: 225 - DNA, 20 bp, synthetic construct
  source 1..20: mol_type = other DNA
cctgggacccaatgtgcatc

SEQ ID NO: 226 - DNA, 20 bp, synthetic construct
  source 1..20: mol_type = other DNA
gtacgaacatttaattggtt

SEQ ID NO: 227 - DNA, 20 bp, synthetic construct
  source 1..20: mol_type = other DNA
gttctcagacgacaacaggc

SEQ ID NO: 228 - DNA, 20 bp, synthetic construct
  source 1..20: mol_type = other DNA
tgttattactcagatcgctc

SEQ ID NO: 229 - DNA, 20 bp, synthetic construct
  source 1..20: mol_type = other DNA
gtagccataccttgttcctc

SEQ ID NO: 230 - DNA, 20 bp, synthetic construct
  source 1..20: mol_type = other DNA
gctggatagtcaaatcatgt

SEQ ID NO: 231 - DNA, 20 bp, synthetic construct
  source 1..20: mol_type = other DNA
aacccaccccttaaccttac

SEQ ID NO: 232 - DNA, 20 bp, synthetic construct
  source 1..20: mol_type = other DNA
tgggcccgcctcaaggacca

SEQ ID NO: 233 - DNA, 20 bp, synthetic construct
  source 1..20: mol_type = other DNA
ccagtctaagtacagactgc

SEQ ID NO: 234 - DNA, 20 bp, synthetic construct
  source 1..20: mol_type = other DNA
agtgtatctgatccctcaat

SEQ ID NO: 235 - DNA, 20 bp, synthetic construct
  source 1..20: mol_type = other DNA
atcttgggcctactcactca

SEQ ID NO: 236 - DNA, 20 bp, synthetic construct
  source 1..20: mol_type = other DNA
tcccccggacaaagaagcct

SEQ ID NO: 237 - DNA, 20 bp, synthetic construct
  source 1..20: mol_type = other DNA
agtgagtcctattacccacc

SEQ ID NO: 238 - DNA, 20 bp, synthetic construct
  source 1..20: mol_type = other DNA
tccaagtactagtcccatgc

SEQ ID NO: 239 - DNA, 20 bp, synthetic construct
  source 1..20: mol_type = other DNA
gaggtttgatattactccca

SEQ ID NO: 240 - DNA, 20 bp, synthetic construct
  source 1..20: mol_type = other DNA
gcaatatgaaccacacctag

SEQ ID NO: 241 - DNA, 20 bp, synthetic construct
  source 1..20: mol_type = other DNA
cgccacaccttgcttaccct

SEQ ID NO: 242 - DNA, 20 bp, synthetic construct
  source 1..20: mol_type = other DNA
ccaccccttgttattgccac

SEQ ID NO: 243 - DNA, 20 bp, synthetic construct
  source 1..20: mol_type = other DNA
cagactcgcgcccaattttc

SEQ ID NO: 244 - DNA, 20 bp, synthetic construct
  source 1..20: mol_type = other DNA
ggtctgattgtacaaagcat

SEQ ID NO: 245 - DNA, 20 bp, synthetic construct
  source 1..20: mol_type = other DNA
tgtccagttagatccactct

SEQ ID NO: 246 - DNA, 20 bp, synthetic construct
  source 1..20: mol_type = other DNA
cgccaaaggatctttaactc

SEQ ID NO: 247 - DNA, 20 bp, synthetic construct
  source 1..20: mol_type = other DNA
cgtaccctaactcaccatac

SEQ ID NO: 248 - DNA, 20 bp, synthetic construct
  source 1..20: mol_type = other DNA
cacccgtaccctaactcacc

SEQ ID NO: 249 - DNA, 20 bp, synthetic construct
  source 1..20: mol_type = other DNA
tgtatggtattagctactcc

SEQ ID NO: 250 - DNA, 20 bp, synthetic construct
  source 1..20: mol_type = other DNA
ctgtctcccccggatttact

SEQ ID NO: 251 - DNA, 20 bp, synthetic construct
  source 1..20: mol_type = other DNA
tacccacactatctcaggcc

SEQ ID NO: 252 - DNA, 20 bp, synthetic construct
  source 1..20: mol_type = other DNA
gcacactacattcacagggc

SEQ ID NO: 253 - DNA, 20 bp, synthetic construct
  source 1..20: mol_type = other DNA
ccacatcaatatgtccgagt

SEQ ID NO: 254 - DNA, 20 bp, synthetic construct
  source 1..20: mol_type = other DNA
ctgattgacagccaaccccc

SEQ ID NO: 255 - DNA, 20 bp, synthetic construct
  source 1..20: mol_type = other DNA
ggctggctagtctgctttgt

SEQ ID NO: 256 - DNA, 20 bp, synthetic construct
  source 1..20: mol_type = other DNA
ccaattgtagccggctggct

SEQ ID NO: 257 - DNA, 20 bp, synthetic construct
  source 1..20: mol_type = other DNA
tgactccaattgtagccggc

SEQ ID NO: 258 - DNA, 20 bp, synthetic construct
  source 1..20: mol_type = other DNA
ccggtggtgtagaagccctc

SEQ ID NO: 259 - DNA, 20 bp, synthetic construct
  source 1..20: mol_type = other DNA
tgcctgactgcgccggtggt

SEQ ID NO: 260 - DNA, 20 bp, synthetic construct
  source 1..20: mol_type = other DNA
agtcgccaaagatctgcctg

SEQ ID NO: 261 - DNA, 20 bp, synthetic construct
  source 1..20: mol_type = other DNA
ggtggtcttgtagtcgccaa

SEQ ID NO: 262 - DNA, 20 bp, synthetic construct
  source 1..20: mol_type = other DNA
ccgcagatggtggtcttgta

SEQ ID NO: 263 - DNA, 20 bp, synthetic construct
  source 1..20: mol_type = other DNA
ggcccttgccgcagatggtg

SEQ ID NO: 264 - DNA, 20 bp, synthetic construct
  source 1..20: mol_type = other DNA
ttgcgctcaggcccttgccg

SEQ ID NO: 265 - DNA, 20 bp, synthetic construct
  source 1..20: mol_type = other DNA
gttaccgttgcgctcaggcc

SEQ ID NO: 266 - DNA, 20 bp, synthetic construct
  source 1..20: mol_type = other DNA
ccctgttaccgttgcgctca

SEQ ID NO: 267 - DNA, 20 bp, synthetic construct
  source 1..20: mol_type = other DNA
cttctggccccctgttaccg

SEQ ID NO: 268 - DNA, 20 bp, synthetic construct
  source 1..20: mol_type = other DNA
acccgctccaaagaatgagc

SEQ ID NO: 269 - DNA, 20 bp, synthetic construct
  source 1..20: mol_type = other DNA
tcgggatgtcctagccattt

SEQ ID NO: 270 - DNA, 20 bp, synthetic construct
  source 1..20: mol_type = other DNA
ccacacaacggtcagggcat

SEQ ID NO: 271 - DNA, 20 bp, synthetic construct
  source 1..20: mol_type = other DNA
accaggagccacacaacggt

SEQ ID NO: 272 - DNA, 20 bp, synthetic construct
  source 1..20: mol_type = other DNA
gagactgcctatactggcag

SEQ ID NO: 273 - DNA, 20 bp, synthetic construct
  source 1..20: mol_type = other DNA
aacttggtgcctcggcccat

SEQ ID NO: 274 - DNA, 20 bp, synthetic construct
  source 1..20: mol_type = other DNA
ggatcagaacttggtgcctc

SEQ ID NO: 275 - DNA, 20 bp, synthetic construct
  source 1..20: mol_type = other DNA
tgtgtggttagagcctcgct

SEQ ID NO: 276 - DNA, 20 bp, synthetic construct
  source 1..20: mol_type = other DNA
gagacgcagcattgtaggct

SEQ ID NO: 277 - DNA, 20 bp, synthetic construct
  source 1..20: mol_type = other DNA
tcagtggaagtaccctttga

SEQ ID NO: 278 - DNA, 20 bp, synthetic construct
  source 1..20: mol_type = other DNA
aagatccttgctttgacccc

SEQ ID NO: 279 - DNA, 20 bp, synthetic construct
  source 1..20: mol_type = other DNA
ggcttcagtagtccatcgcc

SEQ ID NO: 280 - DNA, 20 bp, synthetic construct
  source 1..20: mol_type = other DNA
gagttagggcttcagtagtc

SEQ ID NO: 281 - DNA, 20 bp, synthetic construct
  source 1..20: mol_type = other DNA
atgctgtaagtaaggttggc

SEQ ID NO: 282 - DNA, 20 bp, synthetic construct
  source 1..20: mol_type = other DNA
cgctcccttatgctgtaagt

SEQ ID NO: 283 - DNA, 20 bp, synthetic construct
  source 1..20: mol_type = other DNA
tctacgctcccttatgctgt

SEQ ID NO: 284 - DNA, 20 bp, synthetic construct
  source 1..20: mol_type = other DNA
acacagattctacgctccct

SEQ ID NO: 285 - DNA, 20 bp, synthetic construct
  source 1..20: mol_type = other DNA
gtctacacagattctacgct

SEQ ID NO: 286 - DNA, 20 bp, synthetic construct
  source 1..20: mol_type = other DNA
ccctaacgaggtgtaaggcc

SEQ ID NO: 287 - DNA, 20 bp, synthetic construct
  source 1..20: mol_type = other DNA
agggttgtcatggtagctgt

SEQ ID NO: 288 - DNA, 20 bp, synthetic construct
  source 1..20: mol_type = other DNA
agggccatctcaggttacac

SEQ ID NO: 289 - DNA, 20 bp, synthetic construct
  source 1..20: mol_type = other DNA
gaccttcaaatcacctacga

SEQ ID NO: 290 - DNA, 20 bp, synthetic construct
  source 1..20: mol_type = other DNA
cctggaagcttaccaactga

SEQ ID NO: 291 - DNA, 20 bp, synthetic construct
  source 1..20: mol_type = other DNA
acggattacttcactgtcct

SEQ ID NO: 292 - DNA, 20 bp, synthetic construct
  source 1..20: mol_type = other DNA
aggtacggattacttcactg

SEQ ID NO: 293 - DNA, 20 bp, synthetic construct
  source 1..20: mol_type = other DNA
ggtctaattggtgtgggata

SEQ ID NO: 294 - DNA, 20 bp, synthetic construct
  source 1..20: mol_type = other DNA
cgctttgctgcagagacatc

SEQ ID NO: 295 - DNA, 20 bp, synthetic construct
  source 1..20: mol_type = other DNA
tcattgtgtagactgaactc

SEQ ID NO: 296 - DNA, 20 bp, synthetic construct
  source 1..20: mol_type = other DNA
cctcatagggtatcttccca

SEQ ID NO: 297 - DNA, 20 bp, synthetic construct
  source 1..20: mol_type = other DNA
atcgccaaatgtgtctcctc

SEQ ID NO: 298 - DNA, 20 bp, synthetic construct
  source 1..20: mol_type = other DNA
ggtatggtctcctggaactt

SEQ ID NO: 299 - DNA, 20 bp, synthetic construct
  source 1..20: mol_type = other DNA
gctcccaaagtccttccgaa

SEQ ID NO: 300 - DNA, 20 bp, synthetic construct
  source 1..20: mol_type = other DNA
ggctagacagtgctcagtgg

SEQ ID NO: 301 - DNA, 20 bp, synthetic construct
  source 1..20: mol_type = other DNA
ggtgattcagtgacctgtcc

SEQ ID NO: 302 - DNA, 20 bp, synthetic construct
  source 1..20: mol_type = other DNA
acctatccagtcagctcggc

SEQ ID NO: 303 - DNA, 20 bp, synthetic construct
  source 1..20: mol_type = other DNA
gtccagtaccttgttagaga

SEQ ID NO: 304 - DNA, 20 bp, synthetic construct
  source 1..20: mol_type = other DNA
gcagaggctgtacgaacatt

SEQ ID NO: 305 - DNA, 20 bp, synthetic construct
  source 1..20: mol_type = other DNA
gctacacccacttactgcaa

SEQ ID NO: 306 - DNA, 20 bp, synthetic construct
  source 1..20: mol_type = other DNA
gagttctaccttaatgggtt

SEQ ID NO: 307 - DNA, 20 bp, synthetic construct
  source 1..20: mol_type = other DNA
cactcctcttcagacgcgca

SEQ ID NO: 308 - DNA, 20 bp, synthetic construct
  source 1..20: mol_type = other DNA
agtgctggaaaacagtcccg

SEQ ID NO: 309 - DNA, 20 bp, synthetic construct
  source 1..20: mol_type = other DNA
ggtctcgaatctgcactaca

SEQ ID NO: 310 - DNA, 20 bp, synthetic construct
  source 1..20: mol_type = other DNA
tcaagggactgtgttgatcc

SEQ ID NO: 311 - DNA, 20 bp, synthetic construct
  source 1..20: mol_type = other DNA
ggtatgtgtgaacaatagcc

SEQ ID NO: 312 - DNA, 20 bp, synthetic construct
  source 1..20: mol_type = other DNA
tgagtgtatctgatccctca

SEQ ID NO: 313 - DNA, 20 bp, synthetic construct
  source 1..20: mol_type = other DNA
ccctagcaagtgaccatctt

SEQ ID NO: 314 - DNA, 20 bp, synthetic construct
  source 1..20: mol_type = other DNA
ccatagctcccccggacaaa

SEQ ID NO: 315 - DNA, 20 bp, synthetic construct
  source 1..20: mol_type = other DNA
ggagtgagtcctattaccca

SEQ ID NO: 316 - DNA, 20 bp, synthetic construct
  source 1..20: mol_type = other DNA
gtgttccaagtactagtccc

SEQ ID NO: 317 - DNA, 20 bp, synthetic construct
  source 1..20: mol_type = other DNA
ggaggtttgatattactccc

SEQ ID NO: 318 - DNA, 20 bp, synthetic construct
  source 1..20: mol_type = other DNA
ctccatacctactacgctgg

SEQ ID NO: 319 - DNA, 20 bp, synthetic construct
  source 1..20: mol_type = other DNA
ccagagcgagcaccttaaca

SEQ ID NO: 320 - DNA, 20 bp, synthetic construct
  source 1..20: mol_type = other DNA
gcgcccaattttcccccacc

SEQ ID NO: 321 - DNA, 20 bp, synthetic construct
  source 1..20: mol_type = other DNA
gaggccacagactcgcgccc

SEQ ID NO: 322 - DNA, 20 bp, synthetic construct
  source 1..20: mol_type = other DNA
agttagatccactcttgtgg

SEQ ID NO: 323 - DNA, 20 bp, synthetic construct
  source 1..20: mol_type = other DNA
ttgtccagttagatccactc

SEQ ID NO: 324 - DNA, 20 bp, synthetic construct
  source 1..20: mol_type = other DNA
tgttccctagccattgaaca

SEQ ID NO: 325 - DNA, 20 bp, synthetic construct
  source 1..20: mol_type = other DNA
ccgtaccctaactcaccata

SEQ ID NO: 326 - DNA, 20 bp, synthetic construct
  source 1..20: mol_type = other DNA
gtaggccaatgtgaatggcc

SEQ ID NO: 327 - DNA, 20 bp, synthetic construct
  source 1..20: mol_type = other DNA
ttgtatggtattagctactc

SEQ ID NO: 328 - DNA, 20 bp, synthetic construct
  source 1..20: mol_type = other DNA
tggcccattaacacccagat

SEQ ID NO: 329 - DNA, 20 bp, synthetic construct
  source 1..20: mol_type = other DNA
gtacggagcctccacccttt

SEQ ID NO: 330 - DNA, 20 bp, synthetic construct
  source 1..20: mol_type = other DNA
agtagagctctcccctggtt

SEQ ID NO: 331 - DNA, 20 bp, synthetic construct
  source 1..20: mol_type = other DNA
agtccgatgtctctgaggca

SEQ ID NO: 332 - DNA, 20 bp, synthetic construct
  source 1..20: mol_type = other DNA
gctccctttgatttttcaca

SEQ ID NO: 333 - DNA, 20 bp, synthetic construct
  source 1..20: mol_type = other DNA
tctatatcaggagaaaataa

SEQ ID NO: 334 - DNA, 20 bp, synthetic construct
  source 1..20: mol_type = other DNA
tccttctattctcagctcct

SEQ ID NO: 335 - DNA, 20 bp, synthetic construct
  source 1..20: mol_type = other DNA
catggtagctgttatcaagg

SEQ ID NO: 336 - DNA, 20 bp, synthetic construct
  source 1..20: mol_type = other DNA
cattagctagaaagaacgat

SEQ ID NO: 337 - DNA, 20 bp, synthetic construct
  source 1..20: mol_type = other DNA
catgaatacagctttctgaa

SEQ ID NO: 338 - DNA, 20 bp, synthetic construct
  source 1..20: mol_type = other DNA
aagatatgacagaggccaga

SEQ ID NO: 339 - DNA, 20 bp, synthetic construct
  source 1..20: mol_type = other DNA
tcaagtaagaagagggccag

SEQ ID NO: 340 - DNA, 20 bp, synthetic construct
  source 1..20: mol_type = other DNA
agattcagcctataagtcaa

SEQ ID NO: 341 - DNA, 20 bp, synthetic construct
  source 1..20: mol_type = other DNA
caattcagtaatatcagcat

SEQ ID NO: 342 - DNA, 20 bp, synthetic construct
  source 1..20: mol_type = other DNA
ttatctatcctgtgtctacc

SEQ ID NO: 343 - DNA, 20 bp, synthetic construct
  source 1..20: mol_type = other DNA
caatttttaatatcatttgt

SEQ ID NO: 344 - DNA, 20 bp, synthetic construct
  source 1..20: mol_type = other DNA
tcttacaaaacattttccct

SEQ ID NO: 345 - DNA, 20 bp, synthetic construct
  source 1..20: mol_type = other DNA
tttctgcaaaggcagaatac

SEQ ID NO: 346 - DNA, 20 bp, synthetic construct
  source 1..20: mol_type = other DNA
gaaaatcccaatagattcaa

SEQ ID NO: 347 - DNA, 20 bp, synthetic construct
  source 1..20: mol_type = other DNA
cattctaaaacaaatcaaga

SEQ ID NO: 348 - DNA, 20 bp, synthetic construct
  source 1..20: mol_type = other DNA
ctaacaattcaggcagccaa

SEQ ID NO: 349 - DNA, 20 bp, synthetic construct
  source 1..20: mol_type = other DNA
tgtagacacacagccacatc

SEQ ID NO: 350 - DNA, 20 bp, synthetic construct
  source 1..20: mol_type = other DNA
cctttgagaagaaattactt

SEQ ID NO: 351 - DNA, 20 bp, synthetic construct
  source 1..20: mol_type = other DNA
ttaatcactgcaagactctc

SEQ ID NO: 352 - DNA, 20 bp, synthetic construct
  source 1..20: mol_type = other DNA
tcagcaagacctgggacata

SEQ ID NO: 353 - DNA, 20 bp, synthetic construct
  source 1..20: mol_type = other DNA
ccatgatggaaattcagtgt

SEQ ID NO: 354 - DNA, 20 bp, synthetic construct
  source 1..20: mol_type = other DNA
aacacaactctttacaacaa

SEQ ID NO: 355 - DNA, 20 bp, synthetic construct
  source 1..20: mol_type = other DNA
tcaccttatctttgttgaaa

SEQ ID NO: 356 - DNA, 20 bp, synthetic construct
  source 1..20: mol_type = other DNA
agtggcagcaatcatgaagg

SEQ ID NO: 357 - DNA, 20 bp, synthetic construct
  source 1..20: mol_type = other DNA
tctgagtagaaactaccacc

SEQ ID NO: 358 - DNA, 20 bp, synthetic construct
  source 1..20: mol_type = other DNA
atgctgacaacaccctgttt

SEQ ID NO: 359 - DNA, 20 bp, synthetic construct
  source 1..20: mol_type = other DNA
gccacactcacttttctata

SEQ ID NO: 360 - DNA, 20 bp, synthetic construct
  source 1..20: mol_type = other DNA
tgagcatctttccttccact

SEQ ID NO: 361 - DNA, 20 bp, synthetic construct
  source 1..20: mol_type = other DNA
tagatggcaagaggaccaaa

SEQ ID NO: 362 - DNA, 20 bp, synthetic construct
  source 1..20: mol_type = other DNA
ttgtatactggtttgaaaac

SEQ ID NO: 363 - DNA, 20 bp, synthetic construct
  source 1..20: mol_type = other DNA
aaagctcttacatctcctta

SEQ ID NO: 364 - DNA, 20 bp, synthetic construct
  source 1..20: mol_type = other DNA
gataacattgctaagtaaaa

SEQ ID NO: 365 - DNA, 20 bp, synthetic construct
  source 1..20: mol_type = other DNA
tttgattgagaacattctta

SEQ ID NO: 366 - DNA, 20 bp, synthetic construct
  source 1..20: mol_type = other DNA
tcacatagttcataagtagc

SEQ ID NO: 367 - DNA, 20 bp, synthetic construct
  source 1..20: mol_type = other DNA
caaatcacctacgatgactg

SEQ ID NO: 368 - DNA, 20 bp, synthetic construct
  source 1..20: mol_type = other DNA
cattccaatttatgtgcaag

SEQ ID NO: 369 - DNA, 20 bp, synthetic construct
  source 1..20: mol_type = other DNA
tcaaagaattattctccaga

SEQ ID NO: 370 - DNA, 20 bp, synthetic construct
  source 1..20: mol_type = other DNA
ctcaaattgagattcaaatt

SEQ ID NO: 371 - DNA, 20 bp, synthetic construct
  source 1..20: mol_type = other DNA
actttcagttgattaactct

SEQ ID NO: 372 - DNA, 20 bp, synthetic construct
  source 1..20: mol_type = other DNA
ccaattttcccccacccctt

SEQ ID NO: 373 - DNA, 20 bp, synthetic construct
  source 1..20: mol_type = other DNA
gcctcgctattagagaaagg

SEQ ID NO: 374 - DNA, 20 bp, synthetic construct
  source 1..20: mol_type = other DNA
tgactaaaagaggtacataa

SEQ ID NO: 375 - DNA, 20 bp, synthetic construct
  source 1..20: mol_type = other DNA
ccaacaatcaggatcctctt

SEQ ID NO: 376 - DNA, 20 bp, synthetic construct
  source 1..20: mol_type = other DNA
gttccaagtactagtcccat

SEQ ID NO: 377 - DNA, 20 bp, synthetic construct
  source 1..20: mol_type = other DNA
ctaagctaactgctggccac

SEQ ID NO: 378 - DNA, 20 bp, synthetic construct
  source 1..20: mol_type = other DNA
ttcctagtttaaaaaacagt

SEQ ID NO: 379 - DNA, 20 bp, synthetic construct
  source 1..20: mol_type = other DNA
ttgaacagcagtgcactcca

SEQ ID NO: 380 - DNA, 20 bp, synthetic construct
  source 1..20: mol_type = other DNA
ttttgtacaccaaagagaat

SEQ ID NO: 381 - DNA, 20 bp, synthetic construct
  source 1..20: mol_type = other DNA
gcaacattacatgttctata

SEQ ID NO: 382 - DNA, 20 bp, synthetic construct
  source 1..20: mol_type = other DNA
cttattttagtcattcatca

SEQ ID NO: 383 - DNA, 20 bp, synthetic construct
  source 1..20: mol_type = other DNA
aacaaaacacaaggtacgga

SEQ ID NO: 384 - DNA, 20 bp, synthetic construct
  source 1..20: mol_type = other DNA
tgcagttgggaagtcatctt

SEQ ID NO: 385 - DNA, 20 bp, synthetic construct
  source 1..20: mol_type = other DNA
gtagtacaaatctttccttc

SEQ ID NO: 386 - DNA, 20 bp, synthetic construct
  source 1..20: mol_type = other DNA
tttaacccaaagttaacaaa

SEQ ID NO: 387 - DNA, 20 bp, synthetic construct
  source 1..20: mol_type = other DNA
ataccccatgaaatgagcac

SEQ ID NO: 388 - DNA, 20 bp, synthetic construct
  source 1..20: mol_type = other DNA
tgcttgaaaattcaattaga

SEQ ID NO: 389 - DNA, 20 bp, synthetic construct
  source 1..20: mol_type = other DNA
cagtacaagaattaagcaca

SEQ ID NO: 390 - DNA, 20 bp, synthetic construct
  source 1..20: mol_type = other DNA
gcaaagagttaagatgggag

SEQ ID NO: 391 - DNA, 20 bp, synthetic construct
  source 1..20: mol_type = other DNA
accattagccaccagcaact

SEQ ID NO: 392 - DNA, 20 bp, synthetic construct
  source 1..20: mol_type = other DNA
tctgggagctattcaggtct

SEQ ID NO: 393 - DNA, 20 bp, synthetic construct
  source 1..20: mol_type = other DNA
aagtttctaaaagtttatcc

SEQ ID NO: 394 - DNA, 20 bp, synthetic construct
  source 1..20: mol_type = other DNA
ctatcttcagtggtaataga

SEQ ID NO: 395 - DNA, 20 bp, synthetic construct
  source 1..20: mol_type = other DNA
ggtgttttaccttctatgct

SEQ ID NO: 396 - DNA, 20 bp, synthetic construct
  source 1..20: mol_type = other DNA
ccccttctcccagctgcaat

SEQ ID NO: 397 - DNA, 20 bp, synthetic construct
  source 1..20: mol_type = other DNA
agcttaccaactgaatagct

SEQ ID NO: 398 - DNA, 20 bp, synthetic construct
  source 1..20: mol_type = other DNA
gcaattctatatcagaaatg

SEQ ID NO: 399 - DNA, 20 bp, synthetic construct
  source 1..20: mol_type = other DNA
ttgatgtaagtttggcactg

SEQ ID NO: 400 - DNA, 20 bp, synthetic construct
  source 1..20: mol_type = other DNA
tagcaggaaccagctatgaa

SEQ ID NO: 401 - DNA, 20 bp, synthetic construct
  source 1..20: mol_type = other DNA
cccaaataagtaataaacaa

SEQ ID NO: 402 - DNA, 20 bp, synthetic construct
  source 1..20: mol_type = other DNA
caatgttttgctgttcaata

SEQ ID NO: 403 - DNA, 20 bp, synthetic construct
  source 1..20: mol_type = other DNA
actaattaacagaaaaaaag

SEQ ID NO: 404 - DNA, 20 bp, synthetic construct
  source 1..20: mol_type = other DNA
agataggattcctgatgtta

SEQ ID NO: 405 - DNA, 20 bp, synthetic construct
  source 1..20: mol_type = other DNA
gttaaacctaactcttaaca

SEQ ID NO: 406 - DNA, 20 bp, synthetic construct
  source 1..20: mol_type = other DNA
tcagttagtcttcgggcatt

SEQ ID NO: 407 - DNA, 20 bp, synthetic construct
  source 1..20: mol_type = other DNA
taatcactgcaagactctcc

SEQ ID NO: 408 - DNA, 20 bp, synthetic construct
  source 1..20: mol_type = other DNA
tccaatttatgtgcaagcat

SEQ ID NO: 409 - DNA, 20 bp, synthetic construct
  source 1..20: mol_type = other DNA
ctatatcaggagaaaataac

SEQ ID NO: 410 - DNA, 20 bp, synthetic construct
  source 1..20: mol_type = other DNA
ttgctgttcaataatggcat

SEQ ID NO: 411 - DNA, 20 bp, synthetic construct
  source 1..20: mol_type = other DNA
acacaactctttacaacaaa

SEQ ID NO: 412 - DNA, 20 bp, synthetic construct
  source 1..20: mol_type = other DNA
gataggattcctgatgttac

SEQ ID NO: 413 - DNA, 20 bp, synthetic construct
  source 1..20: mol_type = other DNA
acatagttcataagtagcag

SEQ ID NO: 414 - DNA, 20 bp, synthetic construct
  source 1..20: mol_type = other DNA
cacagattctacgctccctt

SEQ ID NO: 415 - DNA, 20 bp, synthetic construct
  source 1..20: mol_type = other DNA
gttgaaataagtgaagacag

SEQ ID NO: 416 - DNA, 20 bp, synthetic construct
  source 1..20: mol_type = other DNA
tagtacaaatctttccttca

SEQ ID NO: 417 - DNA, 20 bp, synthetic construct
  source 1..20: mol_type = other DNA
acaaaacacaaggtacggat

SEQ ID NO: 418 - DNA, 20 bp, synthetic construct
  source 1..20: mol_type = other DNA
ataacattgctaagtaaaat

SEQ ID NO: 419 - DNA, 20 bp, synthetic construct
  source 1..20: mol_type = other DNA
cctgtgtctaccagagggcc

SEQ ID NO: 420 - DNA, 20 bp, synthetic construct
  source 1..20: mol_type = other DNA
ccttctcccagctgcaatag

SEQ ID NO: 421 - DNA, 20 bp, synthetic construct
  source 1..20: mol_type = other DNA
cagcaagacctgggacatag

SEQ ID NO: 422 - DNA, 20 bp, synthetic construct
  source 1..20: mol_type = other DNA
gaacagcagtgcactccaca

SEQ ID NO: 423 - DNA, 20 bp, synthetic construct
  source 1..20: mol_type = other DNA
agcaggaaccagctatgaag

SEQ ID NO: 424 - DNA, 20 bp, synthetic construct
  source 1..20: mol_type = other DNA
caaagaattattctccagac

SEQ ID NO: 425 - DNA, 20 bp, synthetic construct
  source 1..20: mol_type = other DNA
tgattgagaacattcttaat

SEQ ID NO: 426 - DNA, 20 bp, synthetic construct
  source 1..20: mol_type = other DNA
cccttgttattgccacaaaa

SEQ ID NO: 427 - DNA, 20 bp, synthetic construct
  source 1..20: mol_type = other DNA
cttacaaaacattttccctc

SEQ ID NO: 428 - DNA, 20 bp, synthetic construct
  source 1..20: mol_type = other DNA
ttaaacctaactcttaacac

SEQ ID NO: 429 - DNA, 20 bp, synthetic construct
  source 1..20: mol_type = other DNA
tttgtacaccaaagagaata

SEQ ID NO: 430 - DNA, 20 bp, synthetic construct
  source 1..20: mol_type = other DNA
atcttcagtggtaatagaga

SEQ ID NO: 431 - DNA, 20 bp, synthetic construct
  source 1..20: mol_type = other DNA
ctgagtagaaactaccacca

SEQ ID NO: 432 - DNA, 20 bp, synthetic construct
  source 1..20: mol_type = other DNA
tcctcataccacttttcttg

SEQ ID NO: 433 - DNA, 20 bp, synthetic construct
  source 1..20: mol_type = other DNA
caagtaagaagagggccagt

SEQ ID NO: 434 - DNA, 20 bp, synthetic construct
  source 1..20: mol_type = other DNA
tcaaattgagattcaaattc

SEQ ID NO: 435 - DNA, 20 bp, synthetic construct
  source 1..20: mol_type = other DNA
caattctatatcagaaatga

SEQ ID NO: 436 - DNA, 20 bp, synthetic construct
  source 1..20: mol_type = other DNA
cagttgggaagtcatcttct

SEQ ID NO: 437 - DNA, 20 bp, synthetic construct
  source 1..20: mol_type = other DNA
gcttaccaactgaatagctg

SEQ ID NO: 438 - DNA, 20 bp, synthetic construct
  source 1..20: mol_type = other DNA
agatatgacagaggccagag

SEQ ID NO: 439 - DNA, 20 bp, synthetic construct
  source 1..20: mol_type = other DNA
tagctgttatcaaggagaag

SEQ ID NO: 440 - DNA, 20 bp, synthetic construct
  source 1..20: mol_type = other DNA
agatggcaagaggaccaaag

SEQ ID NO: 441 - DNA, 20 bp, synthetic construct
  source 1..20: mol_type = other DNA
gtggcagcaatcatgaaggt

SEQ ID NO: 442 - DNA, 20 bp, synthetic construct
  source 1..20: mol_type = other DNA
gactaaaagaggtacataag

SEQ ID NO: 443 - DNA, 20 bp, synthetic construct
  source 1..20: mol_type = other DNA
aattcagtaatatcagcata

SEQ ID NO: 444 - DNA, 20 bp, synthetic construct
  source 1..20: mol_type = other DNA
atgaatacagctttctgaat

SEQ ID NO: 445 - DNA, 20 bp, synthetic construct
  source 1..20: mol_type = other DNA
agtttctaaaagtttatcct

SEQ ID NO: 446 - DNA, 20 bp, synthetic construct
  source 1..20: mol_type = other DNA
tcctagtttaaaaaacagtc

SEQ ID NO: 447 - DNA, 20 bp, synthetic construct
  source 1..20: mol_type = other DNA
gcattttataaaactggacc

SEQ ID NO: 448 - DNA, 20 bp, synthetic construct
  source 1..20: mol_type = other DNA
attctaaaacaaatcaagac

SEQ ID NO: 449 - DNA, 20 bp, synthetic construct
  source 1..20: mol_type = other DNA
ttgagaagaaattactttct

SEQ ID NO: 450 - DNA, 20 bp, synthetic construct
  source 1..20: mol_type = other DNA
actgccattttccttctctg

SEQ ID NO: 451 - DNA, 20 bp, synthetic construct
  source 1..20: mol_type = other DNA
caaagagttaagatgggaga

SEQ ID NO: 452 - DNA, 20 bp, synthetic construct
  source 1..20: mol_type = other DNA
gcactgagtaggctctgaaa

SEQ ID NO: 453 - DNA, 20 bp, synthetic construct
  source 1..20: mol_type = other DNA
tgttattgaaatgtgctgct

SEQ ID NO: 454 - DNA, 20 bp, synthetic construct
  source 1..20: mol_type = other DNA
gtgttttaccttctatgctc

SEQ ID NO: 455 - DNA, 20 bp, synthetic construct
  source 1..20: mol_type = other DNA
attagctagaaagaacgatc

SEQ ID NO: 456 - DNA, 20 bp, synthetic construct
  source 1..20: mol_type = other DNA
ccattagccaccagcaactg

SEQ ID NO: 457 - DNA, 20 bp, synthetic construct
  source 1..20: mol_type = other DNA
ccaagtactagtcccatgct

SEQ ID NO: 458 - DNA, 20 bp, synthetic construct
  source 1..20: mol_type = other DNA
ttaacccaaagttaacaaaa

SEQ ID NO: 459 - DNA, 20 bp, synthetic construct
  source 1..20: mol_type = other DNA
tgctgacaacaccctgtttc

SEQ ID NO: 460 - DNA, 20 bp, synthetic construct
  source 1..20: mol_type = other DNA
cctcgctattagagaaaggg

SEQ ID NO: 461 - DNA, 20 bp, synthetic construct
  source 1..20: mol_type = other DNA
ccaaataagtaataaacaaa

SEQ ID NO: 462 - DNA, 20 bp, synthetic construct
  source 1..20: mol_type = other DNA
gcttgaaaattcaattagag

SEQ ID NO: 463 - DNA, 20 bp, synthetic construct
  source 1..20: mol_type = other DNA
gtacaagaattaagcacact

SEQ ID NO: 464 - DNA, 20 bp, synthetic construct
  source 1..20: mol_type = other DNA
ttctgcaaaggcagaatact

SEQ ID NO: 465 - DNA, 20 bp, synthetic construct
  source 1..20: mol_type = other DNA
aaatcacctacgatgactga

SEQ ID NO: 466 - DNA, 20 bp, synthetic construct
  source 1..20: mol_type = other DNA
cctttgatttttcacagtcc

SEQ ID NO: 467 - DNA, 20 bp, synthetic construct
  source 1..20: mol_type = other DNA
agctcttacatctccttaaa

SEQ ID NO: 468 - DNA, 20 bp, synthetic construct
  source 1..20: mol_type = other DNA
aaaatcccaatagattcaac

SEQ ID NO: 469 - DNA, 20 bp, synthetic construct
  source 1..20: mol_type = other DNA
tgtatactggtttgaaaaca

SEQ ID NO: 470 - DNA, 20 bp, synthetic construct
  source 1..20: mol_type = other DNA
tggaaattcagtgtgaatct

SEQ ID NO: 471 - DNA, 20 bp, synthetic construct
  source 1..20: mol_type = other DNA
taccccatgaaatgagcacc

SEQ ID NO: 472 - DNA, 20 bp, synthetic construct
  source 1..20: mol_type = other DNA
ccttctattctcagctcctt

SEQ ID NO: 473 - DNA, 20 bp, synthetic construct
  source 1..20: mol_type = other DNA
gaacccacacatgttcagcc

SEQ ID NO: 474 - DNA, 20 bp, synthetic construct
  source 1..20: mol_type = other DNA
taacaattcaggcagccaag

SEQ ID NO: 475 - DNA, 20 bp, synthetic construct
  source 1..20: mol_type = other DNA
gtagacacacagccacatca

SEQ ID NO: 476 - DNA, 20 bp, synthetic construct
  source 1..20: mol_type = other DNA
ctaattaacagaaaaaaaga

SEQ ID NO: 477 - DNA, 20 bp, synthetic construct
  source 1..20: mol_type = other DNA
aatttttaatatcatttgtg

SEQ ID NO: 478 - DNA, 20 bp, synthetic construct
  source 1..20: mol_type = other DNA
ttctgttaacattagttaca

SEQ ID NO: 479 - DNA, 20 bp, synthetic construct
  source 1..20: mol_type = other DNA
gcatctttccttccactttg

SEQ ID NO: 480 - DNA, 20 bp, synthetic construct
  source 1..20: mol_type = other DNA
attttagtcattcatcaact

SEQ ID NO: 481 - DNA, 20 bp, synthetic construct
  source 1..20: mol_type = other DNA
ctttcagttgattaactctc

SEQ ID NO: 482 - DNA, 20 bp, synthetic construct
  source 1..20: mol_type = other DNA
ccaatttatgtgcaagcatt

SEQ ID NO: 483 - DNA, 20 bp, synthetic construct
  source 1..20: mol_type = other DNA
tgtacaccaaagagaatata

SEQ ID NO: 484 - DNA, 20 bp, synthetic construct
  source 1..20: mol_type = other DNA
ctacccatatctgtttccca

SEQ ID NO: 485 - DNA, 20 bp, synthetic construct
  source 1..20: mol_type = other DNA
gctgacaacaccctgtttct

SEQ ID NO: 486 - DNA, 20 bp, synthetic construct
  source 1..20: mol_type = other DNA
acagcagtgcactccacatc

SEQ ID NO: 487 - DNA, 20 bp, synthetic construct
  source 1..20: mol_type = other DNA
ggcagcaatcatgaaggtga

SEQ ID NO: 488 - DNA, 20 bp, synthetic construct
  source 1..20: mol_type = other DNA
ctgagtaggctctgaaagca

SEQ ID NO: 489 - DNA, 20 bp, synthetic construct
  source 1..20: mol_type = other DNA
taaacctaactcttaacaca

SEQ ID NO: 490 - DNA, 20 bp, synthetic construct
  source 1..20: mol_type = other DNA
tctattctcagctccttgga

SEQ ID NO: 491 - DNA, 20 bp, synthetic construct
  source 1..20: mol_type = other DNA
tttccttccactttgtttcc

SEQ ID NO: 492 - DNA, 20 bp, synthetic construct
  source 1..20: mol_type = other DNA
taactaagttttcacttccc

SEQ ID NO: 493 - DNA, 20 bp, synthetic construct
  source 1..20: mol_type = other DNA
tgcaagtagaagtacggagc

SEQ ID NO: 494 - DNA, 20 bp, synthetic construct
  source 1..20: mol_type = other DNA
tcagtaatatcagcataagc

SEQ ID NO: 495 - DNA, 20 bp, synthetic construct
  source 1..20: mol_type = other DNA
aagtaagaagagggccagtt

SEQ ID NO: 496 - DNA, 20 bp, synthetic construct
  source 1..20: mol_type = other DNA
gtatactggtttgaaaacaa

SEQ ID NO: 497 - DNA, 20 bp, synthetic construct
  source 1..20: mol_type = other DNA
aaagagttaagatgggagac

SEQ ID NO: 498 - DNA, 20 bp, synthetic construct
  source 1..20: mol_type = other DNA
ccactgttccctttctcccc

SEQ ID NO: 499 - DNA, 20 bp, synthetic construct
  source 1..20: mol_type = other DNA
ctgtgtctaccagagggcca

SEQ ID NO: 500 - DNA, 20 bp, synthetic construct
  source 1..20: mol_type = other DNA
caagtactagtcccatgctc

SEQ ID NO: 501 - DNA, 20 bp, synthetic construct
  source 1..20: mol_type = other DNA
gtttctaaaagtttatcctt

SEQ ID NO: 502 - DNA, 20 bp, synthetic construct
  source 1..20: mol_type = other DNA
aacattgctaagtaaaatca

SEQ ID NO: 503 - DNA, 20 bp, synthetic construct
  source 1..20: mol_type = other DNA
agattctacgctcccttatg

SEQ ID NO: 504 - DNA, 20 bp, synthetic construct
  source 1..20: mol_type = other DNA
cttctcccagctgcaatagg

SEQ ID NO: 505 - DNA, 20 bp, synthetic construct
  source 1..20: mol_type = other DNA
acattagttacagtttgttt

SEQ ID NO: 506 - DNA, 20 bp, synthetic construct
  source 1..20: mol_type = other DNA
agctgttatcaaggagaagg

SEQ ID NO: 507 - DNA, 20 bp, synthetic construct
  source 1..20: mol_type = other DNA
catagttcataagtagcaga

SEQ ID NO: 508 - DNA, 20 bp, synthetic construct
  source 1..20: mol_type = other DNA
gttattgaaatgtgctgctt

SEQ ID NO: 509 - DNA, 20 bp, synthetic construct
  source 1..20: mol_type = other DNA
caggcagccaagtaagtggt

SEQ ID NO: 510 - DNA, 20 bp, synthetic construct
  source 1..20: mol_type = other DNA
gatggcaagaggaccaaaga

SEQ ID NO: 511 - DNA, 20 bp, synthetic construct
  source 1..20: mol_type = other DNA
caaattgagattcaaattca

SEQ ID NO: 512 - DNA, 20 bp, synthetic construct
  source 1..20: mol_type = other DNA
actaaaagaggtacataaga

SEQ ID NO: 513 - DNA, 20 bp, synthetic construct
  source 1..20: mol_type = other DNA
ccaaaggatctttaactcca

SEQ ID NO: 514 - DNA, 20 bp, synthetic construct
  source 1..20: mol_type = other DNA
gcaggaaccagctatgaagc

SEQ ID NO: 515 - DNA, 20 bp, synthetic construct
  source 1..20: mol_type = other DNA
aattctatatcagaaatgaa

SEQ ID NO: 516 - DNA, 20 bp, synthetic construct
  source 1..20: mol_type = other DNA
ttagtcattcatcaactatt

SEQ ID NO: 517 - DNA, 20 bp, synthetic construct
  source 1..20: mol_type = other DNA
ttctaataatgttaggaggt

SEQ ID NO: 518 - DNA, 20 bp, synthetic construct
  source 1..20: mol_type = other DNA
accccatgaaatgagcacca

SEQ ID NO: 519 - DNA, 20 bp, synthetic construct
  source 1..20: mol_type = other DNA
caaaacacaaggtacggatt

SEQ ID NO: 520 - DNA, 20 bp, synthetic construct
  source 1..20: mol_type = other DNA
ccttctatgctcattggctc

SEQ ID NO: 521 - DNA, 20 bp, synthetic construct
  source 1..20: mol_type = other DNA
ggattcctgatgttacccag

SEQ ID NO: 522 - DNA, 20 bp, synthetic construct
  source 1..20: mol_type = other DNA
tgttcaataatggcattgtg

SEQ ID NO: 523 - DNA, 20 bp, synthetic construct
  source 1..20: mol_type = other DNA
tgttattgccacaaaatcct

SEQ ID NO: 524 - DNA, 20 bp, synthetic construct
  source 1..20: mol_type = other DNA
ttacaaaacattttccctct

SEQ ID NO: 525 - DNA, 20 bp, synthetic construct
  source 1..20: mol_type = other DNA
gatatgacagaggccagagt

SEQ ID NO: 526 - DNA, 20 bp, synthetic construct
  source 1..20: mol_type = other DNA
cattagccaccagcaactgc

SEQ ID NO: 527 - DNA, 20 bp, synthetic construct
  source 1..20: mol_type = other DNA
gccacactttttgcctgggc

SEQ ID NO: 528 - DNA, 20 bp, synthetic construct
  source 1..20: mol_type = other DNA
tgagaagaaattactttctg

SEQ ID NO: 529 - DNA, 20 bp, synthetic construct
  source 1..20: mol_type = other DNA
taacccaaagttaacaaaaa

SEQ ID NO: 530 - DNA, 20 bp, synthetic construct
  source 1..20: mol_type = other DNA
aaagaattattctccagaca

SEQ ID NO: 531 - DNA, 20 bp, synthetic construct
  source 1..20: mol_type = other DNA
ttagctagaaagaacgatca

SEQ ID NO: 532 - DNA, 20 bp, synthetic construct
  source 1..20: mol_type = other DNA
atttttaatatcatttgtga

SEQ ID NO: 533 - DNA, 20 bp, synthetic construct
  source 1..20: mol_type = other DNA
ttctaaaacaaatcaagacc

SEQ ID NO: 534 - DNA, 20 bp, synthetic construct
  source 1..20: mol_type = other DNA
tatatcaggagaaaataacc

SEQ ID NO: 535 - DNA, 20 bp, synthetic construct
  source 1..20: mol_type = other DNA
gagaccaattgtaccctgca

SEQ ID NO: 536 - DNA, 20 bp, synthetic construct
  source 1..20: mol_type = other DNA
cctagtttaaaaaacagtca

SEQ ID NO: 537 - DNA, 20 bp, synthetic construct
  source 1..20: mol_type = other DNA
cttgaaaattcaattagagc

SEQ ID NO: 538 - DNA, 20 bp, synthetic construct
  source 1..20: mol_type = other DNA
cttcagtagtccatcgccat

SEQ ID NO: 539 - DNA, 20 bp, synthetic construct
  source 1..20: mol_type = other DNA
ctgaagagttctctatctcc

SEQ ID NO: 540 - DNA, 20 bp, synthetic construct
  source 1..20: mol_type = other DNA
gattgagaacattcttaatt

SEQ ID NO: 541 - DNA, 20 bp, synthetic construct
  source 1..20: mol_type = other DNA
gctcttacatctccttaaat

SEQ ID NO: 542 - DNA, 20 bp, synthetic construct
  source 1..20: mol_type = other DNA
aatcacctacgatgactgaa

SEQ ID NO: 543 - DNA, 20 bp, synthetic construct
  source 1..20: mol_type = other DNA
ctttgatttttcacagtcca

SEQ ID NO: 544 - DNA, 20 bp, synthetic construct
  source 1..20: mol_type = other DNA
agttgggaagtcatcttctt

SEQ ID NO: 545 - DNA, 20 bp, synthetic construct
  source 1..20: mol_type = other DNA
agtacaaatctttccttcaa

SEQ ID NO: 546 - DNA, 20 bp, synthetic construct
  source 1..20: mol_type = other DNA
tagacacacagccacatcat

SEQ ID NO: 547 - DNA, 20 bp, synthetic construct
  source 1..20: mol_type = other DNA
tacaagaattaagcacacta

SEQ ID NO: 548 - DNA, 20 bp, synthetic construct
  source 1..20: mol_type = other DNA
taattaacagaaaaaaagac

SEQ ID NO: 549 - DNA, 20 bp, synthetic construct
  source 1..20: mol_type = other DNA
aaatcccaatagattcaact

SEQ ID NO: 550 - DNA, 20 bp, synthetic construct
  source 1..20: mol_type = other DNA
aatcactgcaagactctcct

SEQ ID NO: 551 - DNA, 20 bp, synthetic construct
  source 1..20: mol_type = other DNA
tcttcagtggtaatagagag

SEQ ID NO: 552 - DNA, 20 bp, synthetic construct
  source 1..20: mol_type = other DNA
ataagtaataaacaaactgg

SEQ ID NO: 553 - DNA, 20 bp, synthetic construct
  source 1..20: mol_type = other DNA
tctgcaaaggcagaatactt

SEQ ID NO: 554 - DNA, 20 bp, synthetic construct
  source 1..20: mol_type = other DNA
ttaccaactgaatagctgat

SEQ ID NO: 555 - DNA, 20 bp, synthetic construct
  source 1..20: mol_type = other DNA
cagttgattaactctctttg

SEQ ID NO: 556 - DNA, 20 bp, synthetic construct
  source 1..20: mol_type = other DNA
acaactctttacaacaaaag

SEQ ID NO: 557 - DNA, 20 bp, synthetic construct
  source 1..20: mol_type = other DNA
tctaaaacaaatcaagacct

SEQ ID NO: 558 - DNA, 20 bp, synthetic construct
  source 1..20: mol_type = other DNA
aacccaaagttaacaaaaac

SEQ ID NO: 559 - DNA, 20 bp, synthetic construct
  source 1..20: mol_type = other DNA
ccttccactttgtttccatc

SEQ ID NO: 560 - DNA, 20 bp, synthetic construct
  source 1..20: mol_type = other DNA
tatactggtttgaaaacaag

SEQ ID NO: 561 - DNA, 20 bp, synthetic construct
  source 1..20: mol_type = other DNA
ctattctcagctccttggaa

SEQ ID NO: 562 - DNA, 20 bp, synthetic construct
  source 1..20: mol_type = other DNA
ttcagtagtccatcgccatc

SEQ ID NO: 563 - DNA, 20 bp, synthetic construct
  source 1..20: mol_type = other DNA
aaattgagattcaaattcac

SEQ ID NO: 564 - DNA, 20 bp, synthetic construct
  source 1..20: mol_type = other DNA
tgtctaccagagggccatct

SEQ ID NO: 565 - DNA, 20 bp, synthetic construct
  source 1..20: mol_type = other DNA
ctgcaaaggcagaatacttg

SEQ ID NO: 566 - DNA, 20 bp, synthetic construct
  source 1..20: mol_type = other DNA
aatcccaatagattcaacta

SEQ ID NO: 567 - DNA, 20 bp, synthetic construct
  source 1..20: mol_type = other DNA
taccaactgaatagctgatg

SEQ ID NO: 568 - DNA, 20 bp, synthetic construct
  source 1..20: mol_type = other DNA
tgtgcaagcattgggaagct

SEQ ID NO: 569 - DNA, 20 bp, synthetic construct
  source 1..20: mol_type = other DNA
gggtaagaagagccatccac

SEQ ID NO: 570 - DNA, 20 bp, synthetic construct
  source 1..20: mol_type = other DNA
caatcatgaaggtgagctgt

SEQ ID NO: 571 - DNA, 20 bp, synthetic construct
  source 1..20: mol_type = other DNA
gctccattcacctaccatgg

SEQ ID NO: 572 - DNA, 20 bp, synthetic construct
  source 1..20: mol_type = other DNA
tagctagaaagaacgatcag

SEQ ID NO: 573 - DNA, 20 bp, synthetic construct
  source 1..20: mol_type = other DNA
ccccatgaaatgagcaccat

SEQ ID NO: 574 - DNA, 20 bp, synthetic construct
  source 1..20: mol_type = other DNA
ctagtttaaaaaacagtcat

SEQ ID NO: 575 - DNA, 20 bp, synthetic construct
  source 1..20: mol_type = other DNA
ctaaaagaggtacataagag

SEQ ID NO: 576 - DNA, 20 bp, synthetic construct
  source 1..20: mol_type = other DNA
attagccaccagcaactgct

SEQ ID NO: 577 - DNA, 20 bp, synthetic construct
  source 1..20: mol_type = other DNA
cttcagtggtaatagagaga

SEQ ID NO: 578 - DNA, 20 bp, synthetic construct
  source 1..20: mol_type = other DNA
gccaagtagatgactgacta

SEQ ID NO: 579 - DNA, 20 bp, synthetic construct
  source 1..20: mol_type = other DNA
gattctacgctcccttatgc

SEQ ID NO: 580 - DNA, 20 bp, synthetic construct
  source 1..20: mol_type = other DNA
ctgacaacaccctgtttctc

SEQ ID NO: 581 - DNA, 20 bp, synthetic construct
  source 1..20: mol_type = other DNA
ttgtcagacaggattttagc

SEQ ID NO: 582 - DNA, 20 bp, synthetic construct
  source 1..20: mol_type = other DNA
tgtttcccatggtcaagcca

SEQ ID NO: 583 - DNA, 20 bp, synthetic construct
  source 1..20: mol_type = other DNA
tgtcccttgaatccagctga

SEQ ID NO: 584 - DNA, 20 bp, synthetic construct
  source 1..20: mol_type = other DNA
atcacctacgatgactgaat

SEQ ID NO: 585 - DNA, 20 bp, synthetic construct
  source 1..20: mol_type = other DNA
attgagaacattcttaattt

SEQ ID NO: 586 - DNA, 20 bp, synthetic construct
  source 1..20: mol_type = other DNA
gagctattcaggtctcaaac

SEQ ID NO: 587 - DNA, 20 bp, synthetic construct
  source 1..20: mol_type = other DNA
acattgctaagtaaaatcat

SEQ ID NO: 588 - DNA, 20 bp, synthetic construct
  source 1..20: mol_type = other DNA
cccatgagtttaaggacggc

SEQ ID NO: 589 - DNA, 20 bp, synthetic construct
  source 1..20: mol_type = other DNA
acagaaaaaaagacatgcta

SEQ ID NO: 590 - DNA, 20 bp, synthetic construct
  source 1..20: mol_type = other DNA
atatcaggagaaaataacct

SEQ ID NO: 591 - DNA, 20 bp, synthetic construct
  source 1..20: mol_type = other DNA
ttgaaaattcaattagagcc

SEQ ID NO: 592 - DNA, 20 bp, synthetic construct
  source 1..20: mol_type = other DNA
gcagagaataatcagctact

SEQ ID NO: 593 - DNA, 20 bp, synthetic construct
  source 1..20: mol_type = other DNA
atggcaagaggaccaaagac

SEQ ID NO: 594 - DNA, 20 bp, synthetic construct
  source 1..20: mol_type = other DNA
tgatttttcacagtccaaga

SEQ ID NO: 595 - DNA, 20 bp, synthetic construct
  source 1..20: mol_type = other DNA
tttttaatatcatttgtgat

SEQ ID NO: 596 - DNA, 20 bp, synthetic construct
  source 1..20: mol_type = other DNA
ctgatgttacccagggcagg

SEQ ID NO: 597 - DNA, 20 bp, synthetic construct
  source 1..20: mol_type = other DNA
ggatctttaactccagagac

SEQ ID NO: 598 - DNA, 20 bp, synthetic construct
  source 1..20: mol_type = other DNA
cactccacatcagaagtagt

SEQ ID NO: 599 - DNA, 20 bp, synthetic construct
  source 1..20: mol_type = other DNA
gtacaccaaagagaatatat

SEQ ID NO: 600 - DNA, 20 bp, synthetic construct
  source 1..20: mol_type = other DNA
agttcataagtagcagatct

SEQ ID NO: 601 - DNA, 20 bp, synthetic construct
  source 1..20: mol_type = other DNA
gttgattaactctctttgtg

SEQ ID NO: 602 - DNA, 20 bp, synthetic construct
  source 1..20: mol_type = other DNA
ttgccacaaaatcctgagga

SEQ ID NO: 603 - DNA, 20 bp, synthetic construct
  source 1..20: mol_type = other DNA
aagaattattctccagacat

SEQ ID NO: 604 - DNA, 20 bp, synthetic construct
  source 1..20: mol_type = other DNA
atatgacagaggccagagta

SEQ ID NO: 605 - DNA, 20 bp, synthetic construct
  source 1..20: mol_type = other DNA
tctaaaagtttatcctttat

SEQ ID NO: 606 - DNA, 20 bp, synthetic construct
  source 1..20: mol_type = other DNA
gctgttatcaaggagaaggg

SEQ ID NO: 607 - DNA, 20 bp, synthetic construct
  source 1..20: mol_type = other DNA
aaacctaactcttaacacac

SEQ ID NO: 608 - DNA, 20 bp, synthetic construct
  source 1..20: mol_type = other DNA
aactaagttttcacttccct

SEQ ID NO: 609 - DNA, 20 bp, synthetic construct
  source 1..20: mol_type = other DNA
caggaaccagctatgaagca

SEQ ID NO: 610 - DNA, 20 bp, synthetic construct
  source 1..20: mol_type = other DNA
agtaataaacaaactggaat

SEQ ID NO: 611 - DNA, 20 bp, synthetic construct
  source 1..20: mol_type = other DNA
gttgggaagtcatcttctta

SEQ ID NO: 612 - DNA, 20 bp, synthetic construct
  source 1..20: mol_type = other DNA
aaaacacaaggtacggatta

SEQ ID NO: 613 - DNA, 20 bp, synthetic construct
  source 1..20: mol_type = other DNA
aaattatctctgtcatggga

SEQ ID NO: 614 - DNA, 20 bp, synthetic construct
  source 1..20: mol_type = other DNA
attctatatcagaaatgaag

SEQ ID NO: 615 - DNA, 20 bp, synthetic construct
  source 1..20: mol_type = other DNA
tacaaaacattttccctctc

SEQ ID NO: 616 - DNA, 20 bp, synthetic construct
  source 1..20: mol_type = other DNA
agaagcttccctccagcatt

SEQ ID NO: 617 - DNA, 20 bp, synthetic construct
  source 1..20: mol_type = other DNA
agtaagaagagggccagttg

SEQ ID NO: 618 - DNA, 20 bp, synthetic construct
  source 1..20: mol_type = other DNA
ccaccacttccaagttccct

SEQ ID NO: 619 - DNA, 20 bp, synthetic construct
  source 1..20: mol_type = other DNA
ccacactttttgcctgggct

SEQ ID NO: 620 - DNA, 20 bp, synthetic construct
  source 1..20: mol_type = other DNA
ccagctgcaataggcagatt

SEQ ID NO: 621 - DNA, 20 bp, synthetic construct
  source 1..20: mol_type = other DNA
tacaaatctttccttcaatt

SEQ ID NO: 622 - DNA, 20 bp, synthetic construct
  source 1..20: mol_type = other DNA
caagaattaagcacactagc

SEQ ID NO: 623 - DNA, 20 bp, synthetic construct
  source 1..20: mol_type = other DNA
gagaagaaattactttctga

SEQ ID NO: 624 - DNA, 20 bp, synthetic construct
  source 1..20: mol_type = other DNA
aagagttaagatgggagacg

SEQ ID NO: 625 - DNA, 20 bp, synthetic construct
  source 1..20: mol_type = other DNA
agacacacagccacatcatg

SEQ ID NO: 626 - DNA, 20 bp, synthetic construct
  source 1..20: mol_type = other DNA
tcatcaactatttatggaat

SEQ ID NO: 627 - DNA, 20 bp, synthetic construct
  source 1..20: mol_type = other DNA
cagtaatatcagcataagca

SEQ ID NO: 628 - DNA, 20 bp, synthetic construct
  source 1..20: mol_type = other DNA
agttctctatctccaggatg

SEQ ID NO: 629 - DNA, 20 bp, synthetic construct
  source 1..20: mol_type = other DNA
tcactgcaagactctccttt

SEQ ID NO: 630 - DNA, 20 bp, synthetic construct
  source 1..20: mol_type = other DNA
caactctttacaacaaaaga

SEQ ID NO: 631 - DNA, 20 bp, synthetic construct
  source 1..20: mol_type = other DNA
ctcttacatctccttaaata

SEQ ID NO: 632 - DNA, 20 bp, synthetic construct
  source 1..20: mol_type = other DNA
ataatgttaggaggtcctcc

SEQ ID NO: 633 - DNA, 20 bp, synthetic construct
  source 1..20: mol_type = other DNA
tctatgctcattggctcagg

SEQ ID NO: 634 - DNA, 20 bp, synthetic construct
  source 1..20: mol_type = other DNA
tgagaacattcttaatttta

SEQ ID NO: 635 - DNA, 20 bp, synthetic construct
  source 1..20: mol_type = other DNA
cttccactttgtttccatca

SEQ ID NO: 636 - DNA, 20 bp, synthetic construct
  source 1..20: mol_type = other DNA
tcagacaggattttagcatg

SEQ ID NO: 637 - DNA, 20 bp, synthetic construct
  source 1..20: mol_type = other DNA
actaagttttcacttcccta

SEQ ID NO: 638 - DNA, 20 bp, synthetic construct
  source 1..20: mol_type = other DNA
gagaataatcagctactgct

SEQ ID NO: 639 - DNA, 20 bp, synthetic construct
  source 1..20: mol_type = other DNA
gtctcgaatctgcactacag

SEQ ID NO: 640 - DNA, 20 bp, synthetic construct
  source 1..20: mol_type = other DNA
tggcaagaggaccaaagaca

SEQ ID NO: 641 - DNA, 20 bp, synthetic construct
  source 1..20: mol_type = other DNA
tgattaactctctttgtgtg

SEQ ID NO: 642 - DNA, 20 bp, synthetic construct
  source 1..20: mol_type = other DNA
acaaaacattttccctctcc

SEQ ID NO: 643 - DNA, 20 bp, synthetic construct
  source 1..20: mol_type = other DNA
taaaagaggtacataagagg

SEQ ID NO: 644 - DNA, 20 bp, synthetic construct
  source 1..20: mol_type = other DNA
ctaaaacaaatcaagacctt

SEQ ID NO: 645 - DNA, 20 bp, synthetic construct
  source 1..20: mol_type = other DNA
cttacatctccttaaatatt

SEQ ID NO: 646 - DNA, 20 bp, synthetic construct
  source 1..20: mol_type = other DNA
cagctgcaataggcagattt

SEQ ID NO: 647 - DNA, 20 bp, synthetic construct
  source 1..20: mol_type = other DNA
aggtagaggcatttgcctct

SEQ ID NO: 648 - DNA, 20 bp, synthetic construct
  source 1..20: mol_type = other DNA
gcttggctttctccatatac

SEQ ID NO: 649 - DNA, 20 bp, synthetic construct
  source 1..20: mol_type = other DNA
aattgagattcaaattcacc

SEQ ID NO: 650 - DNA, 20 bp, synthetic construct
  source 1..20: mol_type = other DNA
caagcattgggaagctgagg

SEQ ID NO: 651 - DNA, 20 bp, synthetic construct
  source 1..20: mol_type = other DNA
tcataagtagcagatctggg

SEQ ID NO: 652 - DNA, 20 bp, synthetic construct
  source 1..20: mol_type = other DNA
tgcaaaggcagaatacttgt

SEQ ID NO: 653 - DNA, 20 bp, synthetic construct
  source 1..20: mol_type = other DNA
tgaaaattcaattagagcct

SEQ ID NO: 654 - DNA, 20 bp, synthetic construct
  source 1..20: mol_type = other DNA
cagaaaaaaagacatgctat

SEQ ID NO: 655 - DNA, 20 bp, synthetic construct
  source 1..20: mol_type = other DNA
agagttaagatgggagacgc

SEQ ID NO: 656 - DNA, 20 bp, synthetic construct
  source 1..20: mol_type = other DNA
atgttgtagaaggcaatcgg

SEQ ID NO: 657 - DNA, 20 bp, synthetic construct
  source 1..20: mol_type = other DNA
ttttaatatcatttgtgatg

SEQ ID NO: 658 - DNA, 20 bp, synthetic construct
  source 1..20: mol_type = other DNA
tatgacagaggccagagtac

SEQ ID NO: 659 - DNA, 20 bp, synthetic construct
  source 1..20: mol_type = other DNA
ctgttatcaaggagaaggga

SEQ ID NO: 660 - DNA, 20 bp, synthetic construct
  source 1..20: mol_type = other DNA
acctctctggtttcagtagg

SEQ ID NO: 661 - DNA, 20 bp, synthetic construct
  source 1..20: mol_type = other DNA
tatcaggagaaaataacctt

SEQ ID NO: 662 - DNA, 20 bp, synthetic construct
  source 1..20: mol_type = other DNA
cactgcaagactctcctttc

SEQ ID NO: 663 - DNA, 20 bp, synthetic construct
  source 1..20: mol_type = other DNA
cccatgaaatgagcaccatt

SEQ ID NO: 664 - DNA, 20 bp, synthetic construct
  source 1..20: mol_type = other DNA
gacacacagccacatcatgc

SEQ ID NO: 665 - DNA, 20 bp, synthetic construct
  source 1..20: mol_type = other DNA
tctaccagagggccatctca

SEQ ID NO: 666 - DNA, 20 bp, synthetic construct
  source 1..20: mol_type = other DNA
agctattcaggtctcaaact

SEQ ID NO: 667 - DNA, 20 bp, synthetic construct
  source 1..20: mol_type = other DNA
agctagaaagaacgatcaga

SEQ ID NO: 668 - DNA, 20 bp, synthetic construct
  source 1..20: mol_type = other DNA
cccatggtcaagccattgag

SEQ ID NO: 669 - DNA, 20 bp, synthetic construct
  source 1..20: mol_type = other DNA
cctcactcaaagcatggata

SEQ ID NO: 670 - DNA, 20 bp, synthetic construct
  source 1..20: mol_type = other DNA
agtaatatcagcataagcat

SEQ ID NO: 671 - DNA, 20 bp, synthetic construct
  source 1..20: mol_type = other DNA
aaacacaaggtacggattac

SEQ ID NO: 672 - DNA, 20 bp, synthetic construct
  source 1..20: mol_type = other DNA
acccaaagttaacaaaaaca

SEQ ID NO: 673 - DNA, 20 bp, synthetic construct
  source 1..20: mol_type = other DNA
ggcaggaattgagttcctcc

SEQ ID NO: 674 - DNA, 20 bp, synthetic construct
  source 1..20: mol_type = other DNA
atcaactatttatggaatac

SEQ ID NO: 675 - DNA, 20 bp, synthetic construct
  source 1..20: mol_type = other DNA
gtaataaacaaactggaata

SEQ ID NO: 676 - DNA, 20 bp, synthetic construct
  source 1..20: mol_type = other DNA
aagaattaagcacactagca

SEQ ID NO: 677 - DNA, 20 bp, synthetic construct
  source 1..20: mol_type = other DNA
agaattattctccagacatt

SEQ ID NO: 678 - DNA, 20 bp, synthetic construct
  source 1..20: mol_type = other DNA
ctaaaagtttatcctttatg

SEQ ID NO: 679 - DNA, 20 bp, synthetic construct
  source 1..20: mol_type = other DNA
gtaagaagagggccagttgg

SEQ ID NO: 680 - DNA, 20 bp, synthetic construct
  source 1..20: mol_type = other DNA
agaagaaattactttctgat

SEQ ID NO: 681 - DNA, 20 bp, synthetic construct
  source 1..20: mol_type = other DNA
tcacctaccatggctgctgt

SEQ ID NO: 682 - DNA, 20 bp, synthetic construct
  source 1..20: mol_type = other DNA
acaaatctttccttcaatta

SEQ ID NO: 683 - DNA, 20 bp, synthetic construct
  source 1..20: mol_type = other DNA
atcccaatagattcaactag

SEQ ID NO: 684 - DNA, 20 bp, synthetic construct
  source 1..20: mol_type = other DNA
tagtttaaaaaacagtcata

SEQ ID NO: 685 - DNA, 20 bp, synthetic construct
  source 1..20: mol_type = other DNA
accaactgaatagctgatga

SEQ ID NO: 686 - DNA, 20 bp, synthetic construct
  source 1..20: mol_type = other DNA
aacacaatccagtggccacc

SEQ ID NO: 687 - DNA, 20 bp, synthetic construct
  source 1..20: mol_type = other DNA
tcacctacgatgactgaatg

SEQ ID NO: 688 - DNA, 20 bp, synthetic construct
  source 1..20: mol_type = other DNA
tcacagtccaagaaatgtcc

SEQ ID NO: 689 - DNA, 20 bp, synthetic construct
  source 1..20: mol_type = other DNA
ggtatggtcagggatggagg

SEQ ID NO: 690 - DNA, 20 bp, synthetic construct
  source 1..20: mol_type = other DNA
catgagtttaaggacggcaa

SEQ ID NO: 691 - DNA, 20 bp, synthetic construct
  source 1..20: mol_type = other DNA
gccacaaaatcctgaggatg

SEQ ID NO: 692 - DNA, 20 bp, synthetic construct
  source 1..20: mol_type = other DNA
aggaaccagctatgaagcaa

SEQ ID NO: 693 - DNA, 20 bp, synthetic construct
  source 1..20: mol_type = other DNA
tgacaacaccctgtttctct

SEQ ID NO: 694 - DNA, 20 bp, synthetic construct
  source 1..20: mol_type = other DNA
gccagccaaaactacactgc

SEQ ID NO: 695 - DNA, 20 bp, synthetic construct
  source 1..20: mol_type = other DNA
cattgctaagtaaaatcatt

SEQ ID NO: 696 - DNA, 20 bp, synthetic construct
  source 1..20: mol_type = other DNA
ttcagtggtaatagagagac

SEQ ID NO: 697 - DNA, 20 bp, synthetic construct
  source 1..20: mol_type = other DNA
aacctaactcttaacacacc

SEQ ID NO: 698 - DNA, 20 bp, synthetic construct
  source 1..20: mol_type = other DNA
ttagccaccagcaactgctg

SEQ ID NO: 699 - DNA, 20 bp, synthetic construct
  source 1..20: mol_type = other DNA
tattctcagctccttggaaa

SEQ ID NO: 700 - DNA, 20 bp, synthetic construct
  source 1..20: mol_type = other DNA
ttgggaagtcatcttcttag

SEQ ID NO: 701 - DNA, 20 bp, synthetic construct
  source 1..20: mol_type = other DNA
actctttacaacaaaagaac

SEQ ID NO: 702 - DNA, 20 bp, synthetic construct
  source 1..20: mol_type = other DNA
cctccagcatttcaaggatg

SEQ ID NO: 703 - DNA, 20 bp, synthetic construct
  source 1..20: mol_type = other DNA
ttctatatcagaaatgaagg

SEQ ID NO: 704 - DNA, 20 bp, synthetic construct
  source 1..20: mol_type = other DNA
tgtcttaattcatatgtatg

SEQ ID NO: 705 - DNA, 20 bp, synthetic construct
  source 1..20: mol_type = other DNA
ggattcatattgatagtata

SEQ ID NO: 706 - DNA, 20 bp, synthetic construct
  source 1..20: mol_type = other DNA
tacaccaaagagaatatatt

SEQ ID NO: 707 - DNA, 20 bp, synthetic construct
  source 1..20: mol_type = other DNA
actccacatcagaagtagtg

SEQ ID NO: 708 - DNA, 20 bp, synthetic construct
  source 1..20: mol_type = other DNA
atactggtttgaaaacaagt

SEQ ID NO: 709 - DNA, 20 bp, synthetic construct
  source 1..20: mol_type = other DNA
gctgcaataggcagatttgg

SEQ ID NO: 710 - DNA, 20 bp, synthetic construct
  source 1..20: mol_type = other DNA
gaattgagttcctccaacat

SEQ ID NO: 711 - DNA, 20 bp, synthetic construct
  source 1..20: mol_type = other DNA
acagccacttttggatggag

SEQ ID NO: 712 - DNA, 20 bp, synthetic construct
  source 1..20: mol_type = other DNA
acctacgatgactgaatgga

SEQ ID NO: 713 - DNA, 20 bp, synthetic construct
  source 1..20: mol_type = other DNA
attgagattcaaattcacca

SEQ ID NO: 714 - DNA, 20 bp, synthetic construct
  source 1..20: mol_type = other DNA
ctattcaggtctcaaactct

SEQ ID NO: 715 - DNA, 20 bp, synthetic construct
  source 1..20: mol_type = other DNA
tgttgtagaaggcaatcggc

SEQ ID NO: 716 - DNA, 20 bp, synthetic construct
  source 1..20: mol_type = other DNA
ggttccctacagttgtgccc

SEQ ID NO: 717 - DNA, 20 bp, synthetic construct
  source 1..20: mol_type = other DNA
ggaagtcatcttcttaggca

SEQ ID NO: 718 - DNA, 20 bp, synthetic construct
  source 1..20: mol_type = other DNA
tcccaatagattcaactagc

SEQ ID NO: 719 - DNA, 20 bp, synthetic construct
  source 1..20: mol_type = other DNA
caaatctttccttcaattaa

SEQ ID NO: 720 - DNA, 20 bp, synthetic construct
  source 1..20: mol_type = other DNA
tgatagtatatagaattcca

SEQ ID NO: 721 - DNA, 20 bp, synthetic construct
  source 1..20: mol_type = other DNA
cacactagcagtgacataga

SEQ ID NO: 722 - DNA, 20 bp, synthetic construct
  source 1..20: mol_type = other DNA
gagaacattcttaattttat

SEQ ID NO: 723 - DNA, 20 bp, synthetic construct
  source 1..20: mol_type = other DNA
atcaggagaaaataaccttt

SEQ ID NO: 724 - DNA, 20 bp, synthetic construct
  source 1..20: mol_type = other DNA
gacaacaccctgtttctctt

SEQ ID NO: 725 - DNA, 20 bp, synthetic construct
  source 1..20: mol_type = other DNA
attgctaagtaaaatcattt

SEQ ID NO: 726 - DNA, 20 bp, synthetic construct
  source 1..20: mol_type = other DNA
tctgcactacagtcttaccc

SEQ ID NO: 727 - DNA, 20 bp, synthetic construct
  source 1..20: mol_type = other DNA
ttacatctccttaaatattg

SEQ ID NO: 728 - DNA, 20 bp, synthetic construct
  source 1..20: mol_type = other DNA
cccaaagttaacaaaaacag

SEQ ID NO: 729 - DNA, 20 bp, synthetic construct
  source 1..20: mol_type = other DNA
ccatggtcaagccattgagg

SEQ ID NO: 730 - DNA, 20 bp, synthetic construct
  source 1..20: mol_type = other DNA
aacacaaggtacggattact

SEQ ID NO: 731 - DNA, 20 bp, synthetic construct
  source 1..20: mol_type = other DNA
gaaaaaaagacatgctatcc

SEQ ID NO: 732 - DNA, 20 bp, synthetic construct
  source 1..20: mol_type = other DNA
ccatgaaatgagcaccattg

SEQ ID NO: 733 - DNA, 20 bp, synthetic construct
  source 1..20: mol_type = other DNA
taaaagtttatcctttatgt

SEQ ID NO: 734 - DNA, 20 bp, synthetic construct
  source 1..20: mol_type = other DNA
tccacatcagaagtagtggc

SEQ ID NO: 735 - DNA, 20 bp, synthetic construct
  source 1..20: mol_type = other DNA
actgcaagactctcctttct

SEQ ID NO: 736 - DNA, 20 bp, synthetic construct
  source 1..20: mol_type = other DNA
gaagaaattactttctgatc

SEQ ID NO: 737 - DNA, 20 bp, synthetic construct
  source 1..20: mol_type = other DNA
aaacacagtatacacatgca

SEQ ID NO: 738 - DNA, 20 bp, synthetic construct
  source 1..20: mol_type = other DNA
gctagaaagaacgatcagat

SEQ ID NO: 739 - DNA, 20 bp, synthetic construct
  source 1..20: mol_type = other DNA
tgttatcaaggagaagggag

SEQ ID NO: 740 - DNA, 20 bp, synthetic construct
  source 1..20: mol_type = other DNA
gaataatcagctactgctct

SEQ ID NO: 741 - DNA, 20 bp, synthetic construct
  source 1..20: mol_type = other DNA
gacaggattttagcatgaag

SEQ ID NO: 742 - DNA, 20 bp, synthetic construct
  source 1..20: mol_type = other DNA
gaaaattcaattagagcctc

SEQ ID NO: 743 - DNA, 20 bp, synthetic construct
  source 1..20: mol_type = other DNA
tcttctttagacctgaagtg

SEQ ID NO: 744 - DNA, 20 bp, synthetic construct
  source 1..20: mol_type = other DNA
ttctcagctccttggaaacc

SEQ ID NO: 745 - DNA, 20 bp, synthetic construct
  source 1..20: mol_type = other DNA
agttaagatgggagacgcag

SEQ ID NO: 746 - DNA, 20 bp, synthetic construct
  source 1..20: mol_type = other DNA
tccactttgtttccatcagt

SEQ ID NO: 747 - DNA, 20 bp, synthetic construct
  source 1..20: mol_type = other DNA
gtgtatgtatgcatgtgagg

SEQ ID NO: 748 - DNA, 20 bp, synthetic construct
  source 1..20: mol_type = other DNA
aaaagaggtacataagaggg

SEQ ID NO: 749 - DNA, 20 bp, synthetic construct
  source 1..20: mol_type = other DNA
tcctgttttacctgaacaca

SEQ ID NO: 750 - DNA, 20 bp, synthetic construct
  source 1..20: mol_type = other DNA
taataaacaaactggaatac

SEQ ID NO: 751 - DNA, 20 bp, synthetic construct
  source 1..20: mol_type = other DNA
ccagcatttcaaggatggaa

SEQ ID NO: 752 - DNA, 20 bp, synthetic construct
  source 1..20: mol_type = other DNA
agacccaatcattcatcatc

SEQ ID NO: 753 - DNA, 20 bp, synthetic construct
  source 1..20: mol_type = other DNA
gggtcagtgctctctttctg

SEQ ID NO: 754 - DNA, 20 bp, synthetic construct
  source 1..20: mol_type = other DNA
aagaagagggccagttggtg

SEQ ID NO: 755 - DNA, 20 bp, synthetic construct
  source 1..20: mol_type = other DNA
ctctttacaacaaaagaact

SEQ ID NO: 756 - DNA, 20 bp, synthetic construct
  source 1..20: mol_type = other DNA
caactgaatagctgatgact

SEQ ID NO: 757 - DNA, 20 bp, synthetic construct
  source 1..20: mol_type = other DNA
aggaacttgaactcttgcta

SEQ ID NO: 758 - DNA, 20 bp, synthetic construct
  source 1..20: mol_type = other DNA
atgacagaggccagagtaca

SEQ ID NO: 759 - DNA, 20 bp, synthetic construct
  source 1..20: mol_type = other DNA
tcagtggtaatagagagacc

SEQ ID NO: 760 - DNA, 20 bp, synthetic construct
  source 1..20: mol_type = other DNA
agtttaaaaaacagtcataa

SEQ ID NO: 761 - DNA, 20 bp, synthetic construct
  source 1..20: mol_type = other DNA
tttaatatcatttgtgatgc

SEQ ID NO: 762 - DNA, 20 bp, synthetic construct
  source 1..20: mol_type = other DNA
tctatatcagaaatgaagga

SEQ ID NO: 763 - DNA, 20 bp, synthetic construct
  source 1..20: mol_type = other DNA
acacacagccacatcatgca

SEQ ID NO: 764 - DNA, 20 bp, synthetic construct
  source 1..20: mol_type = other DNA
ctaccagagggccatctcag

SEQ ID NO: 765 - DNA, 20 bp, synthetic construct
  source 1..20: mol_type = other DNA
tactggtttgaaaacaagta

SEQ ID NO: 766 - DNA, 20 bp, synthetic construct
  source 1..20: mol_type = other DNA
taaaacaaatcaagaccttc

SEQ ID NO: 767 - DNA, 20 bp, synthetic construct
  source 1..20: mol_type = other DNA
tcaactatttatggaatact

SEQ ID NO: 768 - DNA, 20 bp, synthetic construct
  source 1..20: mol_type = other DNA
atgagtttaaggacggcaaa

SEQ ID NO: 769 - DNA, 20 bp, synthetic construct
  source 1..20: mol_type = other DNA
ggcaagaggaccaaagacat

SEQ ID NO: 770 - DNA, 20 bp, synthetic construct
  source 1..20: mol_type = other DNA
gtatgtgtgaacaatagcct

SEQ ID NO: 771 - DNA, 20 bp, synthetic construct
  source 1..20: mol_type = other DNA
cactcaaagcatggataacc

SEQ ID NO: 772 - DNA, 20 bp, synthetic construct
  source 1..20: mol_type = other DNA
aaaacattttccctctcctc

SEQ ID NO: 773 - DNA, 20 bp, synthetic construct
  source 1..20: mol_type = other DNA
cacaatccagtggccaccag

SEQ ID NO: 774 - DNA, 20 bp, synthetic construct
  source 1..20: mol_type = other DNA
gaattattctccagacattt

SEQ ID NO: 775 - DNA, 20 bp, synthetic construct
  source 1..20: mol_type = other DNA
ggaaccagctatgaagcaaa

SEQ ID NO: 776 - DNA, 20 bp, synthetic construct
  source 1..20: mol_type = other DNA
gcaaaggcagaatacttgta

SEQ ID NO: 777 - DNA, 20 bp, synthetic construct
  source 1..20: mol_type = other DNA
acctaactcttaacacacca

SEQ ID NO: 778 - DNA, 20 bp, synthetic construct
  source 1..20: mol_type = other DNA
tctccatatacacttgactg

SEQ ID NO: 779 - DNA, 20 bp, synthetic construct
  source 1..20: mol_type = other DNA
gctgccaggaaacttggcct

SEQ ID NO: 780 - DNA, 20 bp, synthetic construct
  source 1..20: mol_type = other DNA
ccacaaaatcctgaggatga

SEQ ID NO: 781 - DNA, 20 bp, synthetic construct
  source 1..20: mol_type = other DNA
gtaatatcagcataagcatc

SEQ ID NO: 782 - DNA, 20 bp, synthetic construct
  source 1..20: mol_type = other DNA
taaaacttatccttggcaca

SEQ ID NO: 783 - DNA, 20 bp, synthetic construct
  source 1..20: mol_type = other DNA
acaccaaagagaatatattt

SEQ ID NO: 784 - DNA, 20 bp, synthetic construct
  source 1..20: mol_type = other DNA
tagccaccagcaactgctgc

SEQ ID NO: 785 - DNA, 20 bp, synthetic construct
  source 1..20: mol_type = other DNA
cagcatttcaaggatggaag

SEQ ID NO: 786 - DNA, 20 bp, synthetic construct
  source 1..20: mol_type = other DNA
gttatcaaggagaagggagt

SEQ ID NO: 787 - DNA, 20 bp, synthetic construct
  source 1..20: mol_type = other DNA
cctgttttacctgaacacat

SEQ ID NO: 788 - DNA, 20 bp, synthetic construct
  source 1..20: mol_type = other DNA
aaaaaaagacatgctatcca

SEQ ID NO: 789 - DNA, 20 bp, synthetic construct
  source 1..20: mol_type = other DNA
ctaactcttaacacaccaag

SEQ ID NO: 790 - DNA, 20 bp, synthetic construct
  source 1..20: mol_type = other DNA
atatcagcataagcatcaga

SEQ ID NO: 791 - DNA, 20 bp, synthetic construct
  source 1..20: mol_type = other DNA
ttatccttggcacattgtct

SEQ ID NO: 792 - DNA, 20 bp, synthetic construct
  source 1..20: mol_type = other DNA
caaaggcagaatacttgtag

SEQ ID NO: 793 - DNA, 20 bp, synthetic construct
  source 1..20: mol_type = other DNA
gaaccagctatgaagcaaaa

SEQ ID NO: 794 - DNA, 20 bp, synthetic construct
  source 1..20: mol_type = other DNA
ccaaagttaacaaaaacagg

SEQ ID NO: 795 - DNA, 20 bp, synthetic construct
  source 1..20: mol_type = other DNA
gtttaaaaaacagtcataat

SEQ ID NO: 796 - DNA, 20 bp, synthetic construct
  source 1..20: mol_type = other DNA
aacacagtatacacatgcac

SEQ ID NO: 797 - DNA, 20 bp, synthetic construct
  source 1..20: mol_type = other DNA
tcaggagaaaataaccttta

SEQ ID NO: 798 - DNA, 20 bp, synthetic construct
  source 1..20: mol_type = other DNA
ttaatatcatttgtgatgct

SEQ ID NO: 799 - DNA, 20 bp, synthetic construct
  source 1..20: mol_type = other DNA
ccactttgtttccatcagtg

SEQ ID NO: 800 - DNA, 20 bp, synthetic construct
  source 1..20: mol_type = other DNA
taccagagggccatctcagg

SEQ ID NO: 801 - DNA, 20 bp, synthetic construct
  source 1..20: mol_type = other DNA
ctatatcagaaatgaaggaa

SEQ ID NO: 802 - DNA, 20 bp, synthetic construct
  source 1..20: mol_type = other DNA
taaacaaactggaatacatg

SEQ ID NO: 803 - DNA, 20 bp, synthetic construct
  source 1..20: mol_type = other DNA
actggtttgaaaacaagtat

SEQ ID NO: 804 - DNA, 20 bp, synthetic construct
  source 1..20: mol_type = other DNA
cacacagccacatcatgcag

SEQ ID NO: 805 - DNA, 20 bp, synthetic construct
  source 1..20: mol_type = other DNA
tggtcaagccattgaggact

SEQ ID NO: 806 - DNA, 20 bp, synthetic construct
  source 1..20: mol_type = other DNA
gttccctacagttgtgccca

SEQ ID NO: 807 - DNA, 20 bp, synthetic construct
  source 1..20: mol_type = other DNA
ttgagattcaaattcaccaa

SEQ ID NO: 808 - DNA, 20 bp, synthetic construct
  source 1..20: mol_type = other DNA
gatagtatatagaattccag

SEQ ID NO: 809 - DNA, 20 bp, synthetic construct
  source 1..20: mol_type = other DNA
cctaccagacatcttgcaca

SEQ ID NO: 810 - DNA, 20 bp, synthetic construct
  source 1..20: mol_type = other DNA
caccaaagagaatatatttg

SEQ ID NO: 811 - DNA, 20 bp, synthetic construct
  source 1..20: mol_type = other DNA
aagaaattactttctgatcc

SEQ ID NO: 812 - DNA, 20 bp, synthetic construct
  source 1..20: mol_type = other DNA
tattcaggtctcaaactctt

SEQ ID NO: 813 - DNA, 20 bp, synthetic construct
  source 1..20: mol_type = other DNA
tgacagaggccagagtacac

SEQ ID NO: 814 - DNA, 20 bp, synthetic construct
  source 1..20: mol_type = other DNA
tctcagctccttggaaacca

SEQ ID NO: 815 - DNA, 20 bp, synthetic construct
  source 1..20: mol_type = other DNA
cttcttagtttacatatggg

SEQ ID NO: 816 - DNA, 20 bp, synthetic construct
  source 1..20: mol_type = other DNA
ttaattttataaaatacact

SEQ ID NO: 817 - DNA, 20 bp, synthetic construct
  source 1..20: mol_type = other DNA
aaatctttccttcaattaaa

SEQ ID NO: 818 - DNA, 20 bp, synthetic construct
  source 1..20: mol_type = other DNA
cagccacttttggatggagg

SEQ ID NO: 819 - DNA, 20 bp, synthetic construct
  source 1..20: mol_type = other DNA
gttaagatgggagacgcagc

SEQ ID NO: 820 - DNA, 20 bp, synthetic construct
  source 1..20: mol_type = other DNA
ctagaaagaacgatcagatt

SEQ ID NO: 821 - DNA, 20 bp, synthetic construct
  source 1..20: mol_type = other DNA
gtgaacaatagcctaaagcc

SEQ ID NO: 822 - DNA, 20 bp, synthetic construct
  source 1..20: mol_type = other DNA
gacccaatcattcatcatct

SEQ ID NO: 823 - DNA, 20 bp, synthetic construct
  source 1..20: mol_type = other DNA
ctgcaataggcagatttggg

SEQ ID NO: 824 - DNA, 20 bp, synthetic construct
  source 1..20: mol_type = other DNA
attattctccagacatttct

SEQ ID NO: 825 - DNA, 20 bp, synthetic construct
  source 1..20: mol_type = other DNA
gaacttgaactcttgctagc

SEQ ID NO: 826 - DNA, 20 bp, synthetic construct
  source 1..20: mol_type = other DNA
cagtggtaatagagagacca

SEQ ID NO: 827 - DNA, 20 bp, synthetic construct
  source 1..20: mol_type = other DNA
aaaacaaatcaagaccttca

SEQ ID NO: 828 - DNA, 20 bp, synthetic construct
  source 1..20: mol_type = other DNA
atgaaatgagcaccattgtg

SEQ ID NO: 829 - DNA, 20 bp, synthetic construct
  source 1..20: mol_type = other DNA
cactacagtcttaccctcct

SEQ ID NO: 830 - DNA, 20 bp, synthetic construct
  source 1..20: mol_type = other DNA
aaacattttccctctcctcc

SEQ ID NO: 831 - DNA, 20 bp, synthetic construct
  source 1..20: mol_type = other DNA
tctttacaacaaaagaactg

SEQ ID NO: 832 - DNA, 20 bp, synthetic construct
  source 1..20: mol_type = other DNA
aaaagtttatcctttatgtg

SEQ ID NO: 833 - DNA, 20 bp, synthetic construct
  source 1..20: mol_type = other DNA
gggagagtccaaagagagac

SEQ ID NO: 834 - DNA, 20 bp, synthetic construct
  source 1..20: mol_type = other DNA
ctttctgtgggtgaaagatc

SEQ ID NO: 835 - DNA, 20 bp, synthetic construct
  source 1..20: mol_type = other DNA
tgcaagactctcctttcttg

SEQ ID NO: 836 - DNA, 20 bp, synthetic construct
  source 1..20: mol_type = other DNA
cactagcagtgacatagaca

SEQ ID NO: 837 - DNA, 20 bp, synthetic construct
  source 1..20: mol_type = other DNA
cacatcagaagtagtggcag

SEQ ID NO: 838 - DNA, 20 bp, synthetic construct
  source 1..20: mol_type = other DNA
gtatgtatgcatgtgaggtt

SEQ ID NO: 839 - DNA, 20 bp, synthetic construct
  source 1..20: mol_type = other DNA
tccatatacacttgactgga

SEQ ID NO: 840 - DNA, 20 bp, synthetic construct
  source 1..20: mol_type = other DNA
acaccctgtttctcttccct

SEQ ID NO: 841 - DNA, 20 bp, synthetic construct
  source 1..20: mol_type = other DNA
gttgtagaaggcaatcggct

SEQ ID NO: 842 - DNA, 20 bp, synthetic construct
  source 1..20: mol_type = other DNA
gccaccagcaactgctgctc

SEQ ID NO: 843 - DNA, 20 bp, synthetic construct
  source 1..20: mol_type = other DNA
ttctatatggttgaagtagt

SEQ ID NO: 844 - DNA, 20 bp, synthetic construct
  source 1..20: mol_type = other DNA
acatctccttaaatattgct

SEQ ID NO: 845 - DNA, 20 bp, synthetic construct
  source 1..20: mol_type = other DNA
gagttcctccaacattcacc

SEQ ID NO: 846 - DNA, 20 bp, synthetic construct
  source 1..20: mol_type = other DNA
tgagtttaaggacggcaaag

SEQ ID NO: 847 - DNA, 20 bp, synthetic construct
  source 1..20: mol_type = other DNA
aaaattcaattagagcctcc

SEQ ID NO: 848 - DNA, 20 bp, synthetic construct
  source 1..20: mol_type = other DNA
agaagagggccagttggtgg

SEQ ID NO: 849 - DNA, 20 bp, synthetic construct
  source 1..20: mol_type = other DNA
tcatcttcttaggcatttcc

SEQ ID NO: 850 - DNA, 20 bp, synthetic construct
  source 1..20: mol_type = other DNA
gcaagaggaccaaagacatt

SEQ ID NO: 851 - DNA, 20 bp, synthetic construct
  source 1..20: mol_type = other DNA
aactgaatagctgatgactg

SEQ ID NO: 852 - DNA, 20 bp, synthetic construct
  source 1..20: mol_type = other DNA
actcaaagcatggataaccc

SEQ ID NO: 853 - DNA, 20 bp, synthetic construct
  source 1..20: mol_type = other DNA
tgctaagtaaaatcattttc

SEQ ID NO: 854 - DNA, 20 bp, synthetic construct
  source 1..20: mol_type = other DNA
cctacgatgactgaatggat

SEQ ID NO: 855 - DNA, 20 bp, synthetic construct
  source 1..20: mol_type = other DNA
gccaggaaacttggcctcta

SEQ ID NO: 856 - DNA, 20 bp, synthetic construct
  source 1..20: mol_type = other DNA
caactatttatggaatactc

SEQ ID NO: 857 - DNA, 20 bp, synthetic construct
  source 1..20: mol_type = other DNA
ttctttagacctgaagtgct

SEQ ID NO: 858 - DNA, 20 bp, synthetic construct
  source 1..20: mol_type = other DNA
acacagccacatcatgcagt

SEQ ID NO: 859 - DNA, 20 bp, synthetic construct
  source 1..20: mol_type = other DNA
ccatatacacttgactggaa

SEQ ID NO: 860 - DNA, 20 bp, synthetic construct
  source 1..20: mol_type = other DNA
tcttgtagtcgccaaagatc

SEQ ID NO: 861 - DNA, 20 bp, synthetic construct
  source 1..20: mol_type = other DNA
tcagcataagcatcagatgt

SEQ ID NO: 862 - DNA, 20 bp, synthetic construct
  source 1..20: mol_type = other DNA
ggagagtccaaagagagacc

SEQ ID NO: 863 - DNA, 20 bp, synthetic construct
  source 1..20: mol_type = other DNA
caggagaaaataacctttat

SEQ ID NO: 864 - DNA, 20 bp, synthetic construct
  source 1..20: mol_type = other DNA
aagactctcctttcttgtta

SEQ ID NO: 865 - DNA, 20 bp, synthetic construct
  source 1..20: mol_type = other DNA
tatatcagaaatgaaggaaa

SEQ ID NO: 866 - DNA, 20 bp, synthetic construct
  source 1..20: mol_type = other DNA
ccatgaacagaggcctcctt

SEQ ID NO: 867 - DNA, 20 bp, synthetic construct
  source 1..20: mol_type = other DNA
aaacaaatcaagaccttcaa

SEQ ID NO: 868 - DNA, 20 bp, synthetic construct
  source 1..20: mol_type = other DNA
actttgtttccatcagtgga

SEQ ID NO: 869 - DNA, 20 bp, synthetic construct
  source 1..20: mol_type = other DNA
ccaccagcaactgctgctcc

SEQ ID NO: 870 - DNA, 20 bp, synthetic construct
  source 1..20: mol_type = other DNA
gaaattactttctgatcctc

SEQ ID NO: 871 - DNA, 20 bp, synthetic construct
  source 1..20: mol_type = other DNA
acttgaactcttgctagcca

SEQ ID NO: 872 - DNA, 20 bp, synthetic construct
  source 1..20: mol_type = other DNA
cccaatcattcatcatctta

SEQ ID NO: 873 - DNA, 20 bp, synthetic construct
  source 1..20: mol_type = other DNA
tcccttatgctgtaagtaag

SEQ ID NO: 874 - DNA, 20 bp, synthetic construct
  source 1..20: mol_type = other DNA
ctaccagacatcttgcacag

SEQ ID NO: 875 - DNA, 20 bp, synthetic construct
  source 1..20: mol_type = other DNA
ttattctccagacatttctg

SEQ ID NO: 876 - DNA, 20 bp, synthetic construct
  source 1..20: mol_type = other DNA
caaagttaacaaaaacagga

SEQ ID NO: 877 - DNA, 20 bp, synthetic construct
  source 1..20: mol_type = other DNA
cctgaagtgctgtgggcagg

SEQ ID NO: 878 - DNA, 20 bp, synthetic construct
  source 1..20: mol_type = other DNA
tttaaaaaacagtcataatc

SEQ ID NO: 879 - DNA, 20 bp, synthetic construct
  source 1..20: mol_type = other DNA
accaaagagaatatatttgg

SEQ ID NO: 880 - DNA, 20 bp, synthetic construct
  source 1..20: mol_type = other DNA
gcatttcaaggatggaagca

SEQ ID NO: 881 - DNA, 20 bp, synthetic construct
  source 1..20: mol_type = other DNA
accagagggccatctcaggt

SEQ ID NO: 882 - DNA, 20 bp, synthetic construct
  source 1..20: mol_type = other DNA
acatcagaagtagtggcagt

SEQ ID NO: 883 - DNA, 20 bp, synthetic construct
  source 1..20: mol_type = other DNA
accagctatgaagcaaaatg

SEQ ID NO: 884 - DNA, 20 bp, synthetic construct
  source 1..20: mol_type = other DNA
aaaaaagacatgctatccaa

SEQ ID NO: 885 - DNA, 20 bp, synthetic construct
  source 1..20: mol_type = other DNA
aaattcaattagagcctcca

SEQ ID NO: 886 - DNA, 20 bp, synthetic construct
  source 1..20: mol_type = other DNA
gaagagggccagttggtggc

SEQ ID NO: 887 - DNA, 20 bp, synthetic construct
  source 1..20: mol_type = other DNA
gacagaggccagagtacaca

SEQ ID NO: 888 - DNA, 20 bp, synthetic construct
  source 1..20: mol_type = other DNA
agtttactcagcatgaactt

SEQ ID NO: 889 - DNA, 20 bp, synthetic construct
  source 1..20: mol_type = other DNA
caagaggaccaaagacattc

SEQ ID NO: 890 - DNA, 20 bp, synthetic construct
  source 1..20: mol_type = other DNA
taatatcatttgtgatgctt

SEQ ID NO: 891 - DNA, 20 bp, synthetic construct
  source 1..20: mol_type = other DNA
tctttccttcaattaaaacc

SEQ ID NO: 892 - DNA, 20 bp, synthetic construct
  source 1..20: mol_type = other DNA
taactcttaacacaccaaga

SEQ ID NO: 893 - DNA, 20 bp, synthetic construct
  source 1..20: mol_type = other DNA
ccacttttggatggaggcat

SEQ ID NO: 894 - DNA, 20 bp, synthetic construct
  source 1..20: mol_type = other DNA
ctttacaacaaaagaactgt

SEQ ID NO: 895 - DNA, 20 bp, synthetic construct
  source 1..20: mol_type = other DNA
tgagattcaaattcaccaaa

SEQ ID NO: 896 - DNA, 20 bp, synthetic construct
  source 1..20: mol_type = other DNA
ccctacagttgtgcccaggg

SEQ ID NO: 897 - DNA, 20 bp, synthetic construct
  source 1..20: mol_type = other DNA
gctaagtaaaatcattttcc

SEQ ID NO: 898 - DNA, 20 bp, synthetic construct
  source 1..20: mol_type = other DNA
tatgtatgcatgtgaggttt

SEQ ID NO: 899 - DNA, 20 bp, synthetic construct
  source 1..20: mol_type = other DNA
gggaattaaaaggccagtcc

SEQ ID NO: 900 - DNA, 20 bp, synthetic construct
  source 1..20: mol_type = other DNA
cacaaggtacggattacttc

SEQ ID NO: 901 - DNA, 20 bp, synthetic construct
  source 1..20: mol_type = other DNA
ctggtttgaaaacaagtatc

SEQ ID NO: 902 - DNA, 20 bp, synthetic construct
  source 1..20: mol_type = other DNA
tcttagtttacatatgggag

SEQ ID NO: 903 - DNA, 20 bp, synthetic construct
  source 1..20: mol_type = other DNA
aaacaaactggaatacatga

SEQ ID NO: 904 - DNA, 20 bp, synthetic construct
  source 1..20: mol_type = other DNA
tagtatatagaattccaggc

SEQ ID NO: 905 - DNA, 20 bp, synthetic construct
  source 1..20: mol_type = other DNA
ttgttgtaaaaatgaatccc

SEQ ID NO: 906 - DNA, 20 bp, synthetic construct
  source 1..20: mol_type = other DNA
aagtttatcctttatgtgtg

SEQ ID NO: 907 - DNA, 20 bp, synthetic construct
  source 1..20: mol_type = other DNA
ctacgatgactgaatggata

SEQ ID NO: 908 - DNA, 20 bp, synthetic construct
  source 1..20: mol_type = other DNA
attttataaaatacactttg

SEQ ID NO: 909 - DNA, 20 bp, synthetic construct
  source 1..20: mol_type = other DNA
tcctccaacattcacctctc

SEQ ID NO: 910 - DNA, 20 bp, synthetic construct
  source 1..20: mol_type = other DNA
actgaatagctgatgactgg

SEQ ID NO: 911 - DNA, 20 bp, synthetic construct
  source 1..20: mol_type = other DNA
gtttctcttccctaacgagg

SEQ ID NO: 912 - DNA, 20 bp, synthetic construct
  source 1..20: mol_type = other DNA
aacattttccctctcctcct

SEQ ID NO: 913 - DNA, 20 bp, synthetic construct
  source 1..20: mol_type = other DNA
tagaaagaacgatcagatta

SEQ ID NO: 914 - DNA, 20 bp, synthetic construct
  source 1..20: mol_type = other DNA
caggtctcaaactctttctg

SEQ ID NO: 915 - DNA, 20 bp, synthetic construct
  source 1..20: mol_type = other DNA
catctccttaaatattgctg

SEQ ID NO: 916 - DNA, 20 bp, synthetic construct
  source 1..20: mol_type = other DNA
gaaggcaatcggctaattca

SEQ ID NO: 917 - DNA, 20 bp, synthetic construct
  source 1..20: mol_type = other DNA
aaaggcagaatacttgtaga

SEQ ID NO: 918 - DNA, 20 bp, synthetic construct
  source 1..20: mol_type = other DNA
cttggcacattgtctccacc

SEQ ID NO: 919 - DNA, 20 bp, synthetic construct
  source 1..20: mol_type = other DNA
tccatttcagaacccctcct

SEQ ID NO: 920 - DNA, 20 bp, synthetic construct
  source 1..20: mol_type = other DNA
agtggtaatagagagaccag

SEQ ID NO: 921 - DNA, 20 bp, synthetic construct
  source 1..20: mol_type = other DNA
tcagctccttggaaaccaca

SEQ ID NO: 922 - DNA, 20 bp, synthetic construct
  source 1..20: mol_type = other DNA
ttatcaaggagaagggagtg

SEQ ID NO: 923 - DNA, 20 bp, synthetic construct
  source 1..20: mol_type = other DNA
aactatttatggaatactca

SEQ ID NO: 924 - DNA, 20 bp, synthetic construct
  source 1..20: mol_type = other DNA
tttctgtgggtgaaagatcc

SEQ ID NO: 925 - DNA, 20 bp, synthetic construct
  source 1..20: mol_type = other DNA
tcttcttaggcatttcccat

SEQ ID NO: 926 - DNA, 20 bp, synthetic construct
  source 1..20: mol_type = other DNA
gcacacacacaaatactcag

SEQ ID NO: 927 - DNA, 20 bp, synthetic construct
  source 1..20: mol_type = other DNA
agcatggataaccctcaggc

SEQ ID NO: 928 - DNA, 20 bp, synthetic construct
  source 1..20: mol_type = other DNA
ctgttttacctgaacacatg

SEQ ID NO: 929 - DNA, 20 bp, synthetic construct
  source 1..20: mol_type = other DNA
gagtttaaggacggcaaagt

SEQ ID NO: 930 - DNA, 20 bp, synthetic construct
  source 1..20: mol_type = other DNA
ttaagatgggagacgcagca

SEQ ID NO: 931 - DNA, 20 bp, synthetic construct
  source 1..20: mol_type = other DNA
tgaaatgagcaccattgtga

SEQ ID NO: 932 - DNA, 20 bp, synthetic construct
  source 1..20: mol_type = other DNA
ccatagccaagcctgagtcc

SEQ ID NO: 933 - DNA, 20 bp, synthetic construct
  source 1..20: mol_type = other DNA
ctttccttcaattaaaacca

SEQ ID NO: 934 - DNA, 20 bp, synthetic construct
  source 1..20: mol_type = other DNA
tctccagacatttctgatgc

SEQ ID NO: 935 - DNA, 20 bp, synthetic construct
  source 1..20: mol_type = other DNA
gaaatgagcaccattgtgaa

SEQ ID NO: 936 - DNA, 20 bp, synthetic construct
  source 1..20: mol_type = other DNA
gactctcctttcttgttaca

SEQ ID NO: 937 - DNA, 20 bp, synthetic construct
  source 1..20: mol_type = other DNA
agtatatagaattccaggct

SEQ ID NO: 938 - DNA, 20 bp, synthetic construct
  source 1..20: mol_type = other DNA
agttaacaaaaacaggaaaa

SEQ ID NO: 939 - DNA, 20 bp, synthetic construct
  source 1..20: mol_type = other DNA
tacacttgactggaagtccg

SEQ ID NO: 940 - DNA, 20 bp, synthetic construct
  source 1..20: mol_type = other DNA
aagatgggagacgcagcatt

SEQ ID NO: 941 - DNA, 20 bp, synthetic construct
  source 1..20: mol_type = other DNA
aaggcagaatacttgtagaa

SEQ ID NO: 942 - DNA, 20 bp, synthetic construct
  source 1..20: mol_type = other DNA
gcatgtgaggttttcaggga

SEQ ID NO: 943 - DNA, 20 bp, synthetic construct
  source 1..20: mol_type = other DNA
cacacacaaatactcagcaa

SEQ ID NO: 944 - DNA, 20 bp, synthetic construct
  source 1..20: mol_type = other DNA
tggtttgaaaacaagtatca

SEQ ID NO: 945 - DNA, 20 bp, synthetic construct
  source 1..20: mol_type = other DNA
ccatttcagaacccctcctg

SEQ ID NO: 946 - DNA, 20 bp, synthetic construct
  source 1..20: mol_type = other DNA
aatatcatttgtgatgctta

SEQ ID NO: 947 - DNA, 20 bp, synthetic construct
  source 1..20: mol_type = other DNA
atttcaaggatggaagcagt

SEQ ID NO: 948 - DNA, 20 bp, synthetic construct
  source 1..20: mol_type = other DNA
caaagtactttagatactct

SEQ ID NO: 949 - DNA, 20 bp, synthetic construct
  source 1..20: mol_type = other DNA
ccaaagagaatatatttggc

SEQ ID NO: 950 - DNA, 20 bp, synthetic construct
  source 1..20: mol_type = other DNA
caatagattcaactagccaa

SEQ ID NO: 951 - DNA, 20 bp, synthetic construct
  source 1..20: mol_type = other DNA
ggtctcaaactctttctgcc

SEQ ID NO: 952 - DNA, 20 bp, synthetic construct
  source 1..20: mol_type = other DNA
tctccttaaatattgctgaa

SEQ ID NO: 953 - DNA, 20 bp, synthetic construct
  source 1..20: mol_type = other DNA
tcctcctataatgcagcttg

SEQ ID NO: 954 - DNA, 20 bp, synthetic construct
  source 1..20: mol_type = other DNA
acgatgactgaatggataat

SEQ ID NO: 955 - DNA, 20 bp, synthetic construct
  source 1..20: mol_type = other DNA
cctttatgtgtgttaaaatt

SEQ ID NO: 956 - DNA, 20 bp, synthetic construct
  source 1..20: mol_type = other DNA
ataaaatacactttgtaaga

SEQ ID NO: 957 - DNA, 20 bp, synthetic construct
  source 1..20: mol_type = other DNA
aaggcaatcggctaattcaa

SEQ ID NO: 958 - DNA, 20 bp, synthetic construct
  source 1..20: mol_type = other DNA
gtggtaatagagagaccaga

SEQ ID NO: 959 - DNA, 20 bp, synthetic construct
  source 1..20: mol_type = other DNA
aagagggccagttggtggca

SEQ ID NO: 960 - DNA, 20 bp, synthetic construct
  source 1..20: mol_type = other DNA
gcaaaatgtaagcaaaggga

SEQ ID NO: 961 - DNA, 20 bp, synthetic construct
  source 1..20: mol_type = other DNA
aaattactttctgatcctca

SEQ ID NO: 962 - DNA, 20 bp, synthetic construct
  source 1..20: mol_type = other DNA
agtttaaggacggcaaagtt

SEQ ID NO: 963 - DNA, 20 bp, synthetic construct
  source 1..20: mol_type = other DNA
ttgtatataatatctgttct

SEQ ID NO: 964 - DNA, 20 bp, synthetic construct
  source 1..20: mol_type = other DNA
tttacaacaaaagaactgta

SEQ ID NO: 965 - DNA, 20 bp, synthetic construct
  source 1..20: mol_type = other DNA
ttttggatggaggcatcaca

SEQ ID NO: 966 - DNA, 20 bp, synthetic construct
  source 1..20: mol_type = other DNA
gcatggataaccctcaggca

SEQ ID NO: 967 - DNA, 20 bp, synthetic construct
  source 1..20: mol_type = other DNA
agaaagaacgatcagattac

SEQ ID NO: 968 - DNA, 20 bp, synthetic construct
  source 1..20: mol_type = other DNA
aacaaatcaagaccttcaaa

SEQ ID NO: 969 - DNA, 20 bp, synthetic construct
  source 1..20: mol_type = other DNA
agctccttggaaaccacagg

SEQ ID NO: 970 - DNA, 20 bp, synthetic construct
  source 1..20: mol_type = other DNA
aacaaactggaatacatgaa

SEQ ID NO: 971 - DNA, 20 bp, synthetic construct
  source 1..20: mol_type = other DNA
ccaacattcacctctcatct

SEQ ID NO: 972 - DNA, 20 bp, synthetic construct
  source 1..20: mol_type = other DNA
aggagaaaataacctttatg

SEQ ID NO: 973 - DNA, 20 bp, synthetic construct
  source 1..20: mol_type = other DNA
aactcttaacacaccaagat

SEQ ID NO: 974 - DNA, 20 bp, synthetic construct
  source 1..20: mol_type = other DNA
tgaatagctgatgactggtg

SEQ ID NO: 975 - DNA, 20 bp, synthetic construct
  source 1..20: mol_type = other DNA
ctttgtttccatcagtggaa

SEQ ID NO: 976 - DNA, 20 bp, synthetic construct
  source 1..20: mol_type = other DNA
aacaacaattatcaagaggt

SEQ ID NO: 977 - DNA, 20 bp, synthetic construct
  source 1..20: mol_type = other DNA
cagaggccagagtacacaac

SEQ ID NO: 978 - DNA, 20 bp, synthetic construct
  source 1..20: mol_type = other DNA
caccagcaactgctgctcct

SEQ ID NO: 979 - DNA, 20 bp, synthetic construct
  source 1..20: mol_type = other DNA
tatcagaaatgaaggaaaca

SEQ ID NO: 980 - DNA, 20 bp, synthetic construct
  source 1..20: mol_type = other DNA
gcaataggcagatttgggca

SEQ ID NO: 981 - DNA, 20 bp, synthetic construct
  source 1..20: mol_type = other DNA
caatcattcatcatcttata

SEQ ID NO: 982 - DNA, 20 bp, synthetic construct
  source 1..20: mol_type = other DNA
gagagtccaaagagagacct

SEQ ID NO: 983 - DNA, 20 bp, synthetic construct
  source 1..20: mol_type = other DNA
ccctctcctccttctatgca

SEQ ID NO: 984 - DNA, 20 bp, synthetic construct
  source 1..20: mol_type = other DNA
gaaagtgatgttactggctg

SEQ ID NO: 985 - DNA, 20 bp, synthetic construct
  source 1..20: mol_type = other DNA
tgttgtaaaaatgaatcccg

SEQ ID NO: 986 - DNA, 20 bp, synthetic construct
  source 1..20: mol_type = other DNA
acaaggtacggattacttca

SEQ ID NO: 987 - DNA, 20 bp, synthetic construct
  source 1..20: mol_type = other DNA
accagacatcttgcacagca

SEQ ID NO: 988 - DNA, 20 bp, synthetic construct
  source 1..20: mol_type = other DNA
ccagctatgaagcaaaatga

SEQ ID NO: 989 - DNA, 20 bp, synthetic construct
  source 1..20: mol_type = other DNA
ttaaaaaacagtcataatca

SEQ ID NO: 990 - DNA, 20 bp, synthetic construct
  source 1..20: mol_type = other DNA
ctaagtaaaatcattttcca

SEQ ID NO: 991 - DNA, 20 bp, synthetic construct
  source 1..20: mol_type = other DNA
cttcttaggcatttcccatt

SEQ ID NO: 992 - DNA, 20 bp, synthetic construct
  source 1..20: mol_type = other DNA
tctgtgggtgaaagatcctt

SEQ ID NO: 993 - DNA, 20 bp, synthetic construct
  source 1..20: mol_type = other DNA
ccagagggccatctcaggtt

SEQ ID NO: 994 - DNA, 20 bp, synthetic construct
  source 1..20: mol_type = other DNA
ttttacctgaacacatgctt

SEQ ID NO: 995 - DNA, 20 bp, synthetic construct
  source 1..20: mol_type = other DNA
cgccaaagatctgcctgact

SEQ ID NO: 996 - DNA, 20 bp, synthetic construct
  source 1..20: mol_type = other DNA
gctagccaaaagagaactcc

SEQ ID NO: 997 - DNA, 20 bp, synthetic construct
  source 1..20: mol_type = other DNA
tgtctgatcactgcttataa

SEQ ID NO: 998 - DNA, 20 bp, synthetic construct
  source 1..20: mol_type = other DNA
taagcatcagatgttcatct

SEQ ID NO: 999 - DNA, 20 bp, synthetic construct
  source 1..20: mol_type = other DNA
ggaatactcactatatgccc

SEQ ID NO: 1000 - DNA, 20 bp, synthetic construct
  source 1..20: mol_type = other DNA
atcaaggagaagggagtgag

SEQ ID NO: 1001 - DNA, 20 bp, synthetic construct
  source 1..20: mol_type = other DNA
aaaaagacatgctatccaaa

SEQ ID NO: 1002 - DNA, 20 bp, synthetic construct
  source 1..20: mol_type = other DNA
tcagcatgaactttgcaaac

SEQ ID NO: 1003 - DNA, 20 bp, synthetic construct
  source 1..20: mol_type = other DNA
catagccaagcctgagtcca

SEQ ID NO: 1004 - DNA, 20 bp, synthetic construct
  source 1..20: mol_type = other DNA
aagaggaccaaagacattcc

SEQ ID NO: 1005 - DNA, 20 bp, synthetic construct
  source 1..20: mol_type = other DNA
gagattcaaattcaccaaat

SEQ ID NO: 1006 - DNA, 20 bp, synthetic construct
  source 1..20: mol_type = other DNA
gggaagtaactggtactaga

SEQ ID NO: 1007 - DNA, 20 bp, synthetic construct
  source 1..20: mol_type = other DNA
aattcaattagagcctccat

SEQ ID NO: 1008 - DNA, 20 bp, synthetic construct
  source 1..20: mol_type = other DNA
cctctcctccttctatgcag

SEQ ID NO: 1009 - DNA, 20 bp, synthetic construct
  source 1..20: mol_type = other DNA
ggtgtgagtttgattcaaga

SEQ ID NO: 1010 - DNA, 20 bp, synthetic construct
  source 1..20: mol_type = other DNA
aaaagacatgctatccaaag

SEQ ID NO: 1011 - DNA, 20 bp, synthetic construct
  source 1..20: mol_type = other DNA
acaaatcaagaccttcaaat

SEQ ID NO: 1012 - DNA, 20 bp, synthetic construct
  source 1..20: mol_type = other DNA
gtatataatatctgttctca

SEQ ID NO: 1013 - DNA, 20 bp, synthetic construct
  source 1..20: mol_type = other DNA
agattcaaattcaccaaatc

SEQ ID NO: 1014 - DNA, 20 bp, synthetic construct
  source 1..20: mol_type = other DNA
catgtgaggttttcagggaa

SEQ ID NO: 1015 - DNA, 20 bp, synthetic construct
  source 1..20: mol_type = other DNA
caaagagaatatatttggcc

SEQ ID NO: 1016 - DNA, 20 bp, synthetic construct
  source 1..20: mol_type = other DNA
agagggccagttggtggcaa

SEQ ID NO: 1017 - DNA, 20 bp, synthetic construct
  source 1..20: mol_type = other DNA
ggtttgaaaacaagtatcaa

SEQ ID NO: 1018 - DNA, 20 bp, synthetic construct
  source 1..20: mol_type = other DNA
tcaaggagaagggagtgaga

SEQ ID NO: 1019 - DNA, 20 bp, synthetic construct
  source 1..20: mol_type = other DNA
caaggtacggattacttcac

SEQ ID NO: 1020 - DNA, 20 bp, synthetic construct
  source 1..20: mol_type = other DNA
taagtaaaatcattttccat

SEQ ID NO: 1021 - DNA, 20 bp, synthetic construct
  source 1..20: mol_type = other DNA
actcttaacacaccaagata

SEQ ID NO: 1022 - DNA, 20 bp, synthetic construct
  source 1..20: mol_type = other DNA
atcatttgtgatgcttaatg

SEQ ID NO: 1023 - DNA, 20 bp, synthetic construct
  source 1..20: mol_type = other DNA
gtttgcatcaagcaagcagt

SEQ ID NO: 1024 - DNA, 20 bp, synthetic construct
  source 1..20: mol_type = other DNA
ttacaacaaaagaactgtag

SEQ ID NO: 1025 - DNA, 20 bp, synthetic construct
  source 1..20: mol_type = other DNA
tttgtttccatcagtggaag

SEQ ID NO: 1026 - DNA, 20 bp, synthetic construct
  source 1..20: mol_type = other DNA
gttgtaaaaatgaatcccgc

SEQ ID NO: 1027 - DNA, 20 bp, synthetic construct
  source 1..20: mol_type = other DNA
acacacaaatactcagcaaa

SEQ ID NO: 1028 - DNA, 20 bp, synthetic construct
  source 1..20: mol_type = other DNA
gtgatgttactggctggagt

SEQ ID NO: 1029 - DNA, 20 bp, synthetic construct
  source 1..20: mol_type = other DNA
caataggcagatttgggcaa

SEQ ID NO: 1030 - DNA, 20 bp, synthetic construct
  source 1..20: mol_type = other DNA
tcggctaattcaaaatccag

SEQ ID NO: 1031 - DNA, 20 bp, synthetic construct
  source 1..20: mol_type = other DNA
tcaaggatggaagcagtcta

SEQ ID NO: 1032 - DNA, 20 bp, synthetic construct
  source 1..20: mol_type = other DNA
cagacatcttgcacagcact

SEQ ID NO: 1033 - DNA, 20 bp, synthetic construct
  source 1..20: mol_type = other DNA
aaaatacactttgtaagata

SEQ ID NO: 1034 - DNA, 20 bp, synthetic construct
  source 1..20: mol_type = other DNA
tcttccctaacgaggtgtaa

SEQ ID NO: 1035 - DNA, 20 bp, synthetic construct
  source 1..20: mol_type = other DNA
gaatactcactatatgccca

SEQ ID NO: 1036 - DNA, 20 bp, synthetic construct
  source 1..20: mol_type = other DNA
gctccttggaaaccacaggg

SEQ ID NO: 1037 - DNA, 20 bp, synthetic construct
  source 1..20: mol_type = other DNA
agatcaggtgcccaagtctc

SEQ ID NO: 1038 - DNA, 20 bp, synthetic construct
  source 1..20: mol_type = other DNA
caacaattatcaagaggtgc

SEQ ID NO: 1039 - DNA, 20 bp, synthetic construct
  source 1..20: mol_type = other DNA
taaaaaacagtcataatcaa

SEQ ID NO: 1040 - DNA, 20 bp, synthetic construct
  source 1..20: mol_type = other DNA
aaatgagcaccattgtgaag

SEQ ID NO: 1041 - DNA, 20 bp, synthetic construct
  source 1..20: mol_type = other DNA
tggtaatagagagaccagaa

SEQ ID NO: 1042 - DNA, 20 bp, synthetic construct
  source 1..20: mol_type = other DNA
cagctatgaagcaaaatgac

SEQ ID NO: 1043 - DNA, 20 bp, synthetic construct
  source 1..20: mol_type = other DNA
agaggccagagtacacaact

SEQ ID NO: 1044 - DNA, 20 bp, synthetic construct
  source 1..20: mol_type = other DNA
attcaattagagcctccatt

SEQ ID NO: 1045 - DNA, 20 bp, synthetic construct
  source 1..20: mol_type = other DNA
agagtccaaagagagacctt

SEQ ID NO: 1046 - DNA, 20 bp, synthetic construct
  source 1..20: mol_type = other DNA
tacctgaacacatgcttcaa

SEQ ID NO: 1047 - DNA, 20 bp, synthetic construct
  source 1..20: mol_type = other DNA
ctccagacatttctgatgca

SEQ ID NO: 1048 - DNA, 20 bp, synthetic construct
  source 1..20: mol_type = other DNA
agatgggagacgcagcattg

SEQ ID NO: 1049 - DNA, 20 bp, synthetic construct
  source 1..20: mol_type = other DNA
agtactttagatactctgtt

SEQ ID NO: 1050 - DNA, 20 bp, synthetic construct
  source 1..20: mol_type = other DNA
gcatcagatgttcatctctt

SEQ ID NO: 1051 - DNA, 20 bp, synthetic construct
  source 1..20: mol_type = other DNA
aaatcgattgttgttctcag

SEQ ID NO: 1052 - DNA, 20 bp, synthetic construct
  source 1..20: mol_type = other DNA
tctcaaactctttctgcctg

SEQ ID NO: 1053 - DNA, 20 bp, synthetic construct
  source 1..20: mol_type = other DNA
agcacagagactgcctatac

SEQ ID NO: 1054 - DNA, 20 bp, synthetic construct
  source 1..20: mol_type = other DNA
cgatgactgaatggataata

SEQ ID NO: 1055 - DNA, 20 bp, synthetic construct
  source 1..20: mol_type = other DNA
gccaaagatctgcctgactg

SEQ ID NO: 1056 - DNA, 20 bp, synthetic construct
  source 1..20: mol_type = other DNA
gaaagaacgatcagattact

SEQ ID NO: 1057 - DNA, 20 bp, synthetic construct
  source 1..20: mol_type = other DNA
aattactttctgatcctcag

SEQ ID NO: 1058 - DNA, 20 bp, synthetic construct
  source 1..20: mol_type = other DNA
gtatatagaattccaggcta

SEQ ID NO: 1059 - DNA, 20 bp, synthetic construct
  source 1..20: mol_type = other DNA
cagagggccatctcaggtta

SEQ ID NO: 1060 - DNA, 20 bp, synthetic construct
  source 1..20: mol_type = other DNA
gaatagctgatgactggtgc

SEQ ID NO: 1061 - DNA, 20 bp, synthetic construct
  source 1..20: mol_type = other DNA
ctctcctttcttgttacact

SEQ ID NO: 1062 - DNA, 20 bp, synthetic construct
  source 1..20: mol_type = other DNA
ggagaaaataacctttatgt

SEQ ID NO: 1063 - DNA, 20 bp, synthetic construct
  source 1..20: mol_type = other DNA
aaactggaatacatgaaatg

SEQ ID NO: 1064 - DNA, 20 bp, synthetic construct
  source 1..20: mol_type = other DNA
tcctataatgcagcttggct

SEQ ID NO: 1065 - DNA, 20 bp, synthetic construct
  source 1..20: mol_type = other DNA
aatagattcaactagccaat

SEQ ID NO: 1066 - DNA, 20 bp, synthetic construct
  source 1..20: mol_type = other DNA
ctttatgtgtgttaaaattg

SEQ ID NO: 1067 - DNA, 20 bp, synthetic construct
  source 1..20: mol_type = other DNA
ctccttaaatattgctgaaa

SEQ ID NO: 1068 - DNA, 20 bp, synthetic construct
  source 1..20: mol_type = other DNA
caacattcacctctcatctg

SEQ ID NO: 1069 - DNA, 20 bp, synthetic construct
  source 1..20: mol_type = other DNA
gccaaaagagaactccactt

SEQ ID NO: 1070 - DNA, 20 bp, synthetic construct
  source 1..20: mol_type = other DNA
atcagaaatgaaggaaacac

SEQ ID NO: 1071 - DNA, 20 bp, synthetic construct
  source 1..20: mol_type = other DNA
aggcagaatacttgtagaaa

SEQ ID NO: 1072 - DNA, 20 bp, synthetic construct
  source 1..20: mol_type = other DNA
ctgtgggtgaaagatccttg

SEQ ID NO: 1073 - DNA, 20 bp, synthetic construct
  source 1..20: mol_type = other DNA
tagagacaatagtagccata

SEQ ID NO: 1074 - DNA, 20 bp, synthetic construct
  source 1..20: mol_type = other DNA
acttcagataaatcacttca

SEQ ID NO: 1075 - DNA, 20 bp, synthetic construct
  source 1..20: mol_type = other DNA
acttgactggaagtccgatg

SEQ ID NO: 1076 - DNA, 20 bp, synthetic construct
  source 1..20: mol_type = other DNA
gttaacaaaaacaggaaaag

SEQ ID NO: 1077 - DNA, 20 bp, synthetic construct
  source 1..20: mol_type = other DNA
agaggaccaaagacattcct

SEQ ID NO: 1078 - DNA, 20 bp, synthetic construct
  source 1..20: mol_type = other DNA
gctacatttgtatacaaact

SEQ ID NO: 1079 - DNA, 20 bp, synthetic construct
  source 1..20: mol_type = other DNA
gtttaaggacggcaaagttg

SEQ ID NO: 1080 - DNA, 20 bp, synthetic construct
  source 1..20: mol_type = other DNA
ggatggaggcatcacagtct

SEQ ID NO: 1081 - DNA, 20 bp, synthetic construct
  source 1..20: mol_type = other DNA
ttatgctgtaagtaaggttg

SEQ ID NO: 1082 - DNA, 20 bp, synthetic construct
  source 1..20: mol_type = other DNA
accagcaactgctgctcctc

SEQ ID NO: 1083 - DNA, 20 bp, synthetic construct
  source 1..20: mol_type = other DNA
tccttcaattaaaaccaatc

SEQ ID NO: 1084 - DNA, 20 bp, synthetic construct
  source 1..20: mol_type = other DNA
ttcttaggcatttcccattt

SEQ ID NO: 1085 - DNA, 20 bp, synthetic construct
  source 1..20: mol_type = other DNA
acatcttgcacagcactcta

SEQ ID NO: 1086 - DNA, 20 bp, synthetic construct
  source 1..20: mol_type = other DNA
ctgtatacacattattgtct

SEQ ID NO: 1087 - DNA, 20 bp, synthetic construct
  source 1..20: mol_type = other DNA
caaggagaagggagtgagaa

SEQ ID NO: 1088 - DNA, 20 bp, synthetic construct
  source 1..20: mol_type = other DNA
ctttcttgttacactcatca

SEQ ID NO: 1089 - DNA, 20 bp, synthetic construct
  source 1..20: mol_type = other DNA
gtttgaaaacaagtatcaag

SEQ ID NO: 1090 - DNA, 20 bp, synthetic construct
  source 1..20: mol_type = other DNA
tagctgatgactggtgcatt

SEQ ID NO: 1091 - DNA, 20 bp, synthetic construct
  source 1..20: mol_type = other DNA
tccttaaatattgctgaaac

SEQ ID NO: 1092 - DNA, 20 bp, synthetic construct
  source 1..20: mol_type = other DNA
cgattgttgttctcagaaaa

SEQ ID NO: 1093 - DNA, 20 bp, synthetic construct
  source 1..20: mol_type = other DNA
aactggaatacatgaaatgt

SEQ ID NO: 1094 - DNA, 20 bp, synthetic construct
  source 1..20: mol_type = other DNA
acatttgtatacaaactccc

SEQ ID NO: 1095 - DNA, 20 bp, synthetic construct
  source 1..20: mol_type = other DNA
cctctgtttgatctagcact

SEQ ID NO: 1096 - DNA, 20 bp, synthetic construct
  source 1..20: mol_type = other DNA
ccttcaattaaaaccaatca

SEQ ID NO: 1097 - DNA, 20 bp, synthetic construct
  source 1..20: mol_type = other DNA
tccaggctatagcaagtcat

SEQ ID NO: 1098 - DNA, 20 bp, synthetic construct
  source 1..20: mol_type = other DNA
tttaaggacggcaaagttgt

SEQ ID NO: 1099 - DNA, 20 bp, synthetic construct
  source 1..20: mol_type = other DNA
cacacaaatactcagcaaat

SEQ ID NO: 1100 - DNA, 20 bp, synthetic construct
  source 1..20: mol_type = other DNA
agggccagttggtggcaaag

SEQ ID NO: 1101 - DNA, 20 bp, synthetic construct
  source 1..20: mol_type = other DNA
ttatgtgtgttaaaattgca

SEQ ID NO: 1102 - DNA, 20 bp, synthetic construct
  source 1..20: mol_type = other DNA
cctataatgcagcttggcta

SEQ ID NO: 1103 - DNA, 20 bp, synthetic construct
  source 1..20: mol_type = other DNA
acctgaacacatgcttcaaa

SEQ ID NO: 1104 - DNA, 20 bp, synthetic construct
  source 1..20: mol_type = other DNA
tgaaaactcagtggctgctc

SEQ ID NO: 1105 - DNA, 20 bp, synthetic construct
  source 1..20: mol_type = other DNA
atagattcaactagccaatt

SEQ ID NO: 1106 - DNA, 20 bp, synthetic construct
  source 1..20: mol_type = other DNA
aaagacatgctatccaaaga

SEQ ID NO: 1107 - DNA, 20 bp, synthetic construct
  source 1..20: mol_type = other DNA
aaagagaatatatttggccc

SEQ ID NO: 1108 - DNA, 20 bp, synthetic construct
  source 1..20: mol_type = other DNA
gaggccagagtacacaacta

SEQ ID NO: 1109 - DNA, 20 bp, synthetic construct
  source 1..20: mol_type = other DNA
gattcaaattcaccaaatct

SEQ ID NO: 1110 - DNA, 20 bp, synthetic construct
  source 1..20: mol_type = other DNA
tccagacatttctgatgcaa

SEQ ID NO: 1111 - DNA, 20 bp, synthetic construct
  source 1..20: mol_type = other DNA
cttcagataaatcacttcac

SEQ ID NO: 1112 - DNA, 20 bp, synthetic construct
  source 1..20: mol_type = other DNA
tggtcagacaatgccctgcc

SEQ ID NO: 1113 - DNA, 20 bp, synthetic construct
  source 1..20: mol_type = other DNA
ggatggaagcagtctacctt

SEQ ID NO: 1114 - DNA, 20 bp, synthetic construct
  source 1..20: mol_type = other DNA
cttaggcatttcccatttct

SEQ ID NO: 1115 - DNA, 20 bp, synthetic construct
  source 1..20: mol_type = other DNA
tcagaaatgaaggaaacact

SEQ ID NO: 1116 - DNA, 20 bp, synthetic construct
  source 1..20: mol_type = other DNA
ttactttctgatcctcagga

SEQ ID NO: 1117 - DNA, 20 bp, synthetic construct
  source 1..20: mol_type = other DNA
gtttccatcagtggaagtac

SEQ ID NO: 1118 - DNA, 20 bp, synthetic construct
  source 1..20: mol_type = other DNA
ggaagggttggttatttgtt

SEQ ID NO: 1119 - DNA, 20 bp, synthetic construct
  source 1..20: mol_type = other DNA
agagacaatagtagccatac

SEQ ID NO: 1120 - DNA, 20 bp, synthetic construct
  source 1..20: mol_type = other DNA
atttgtgatgcttaatgtcc

SEQ ID NO: 1121 - DNA, 20 bp, synthetic construct
  source 1..20: mol_type = other DNA
tccttggaaaccacagggtt

SEQ ID NO: 1122 - DNA, 20 bp, synthetic construct
  source 1..20: mol_type = other DNA
tgatccctcaatcatcatcc

SEQ ID NO: 1123 - DNA, 20 bp, synthetic construct
  source 1..20: mol_type = other DNA
cggctaattcaaaatccagc

SEQ ID NO: 1124 - DNA, 20 bp, synthetic construct
  source 1..20: mol_type = other DNA
cagatgttcatctcttcaca

SEQ ID NO: 1125 - DNA, 20 bp, synthetic construct
  source 1..20: mol_type = other DNA
cttccctaacgaggtgtaag

SEQ ID NO: 1126 - DNA, 20 bp, synthetic construct
  source 1..20: mol_type = other DNA
cccgcattgaaggttggctc

SEQ ID NO: 1127 - DNA, 20 bp, synthetic construct
  source 1..20: mol_type = other DNA
aaagaacgatcagattactc

SEQ ID NO: 1128 - DNA, 20 bp, synthetic construct
  source 1..20: mol_type = other DNA
atgactgaatggataatacc

SEQ ID NO: 1129 - DNA, 20 bp, synthetic construct
  source 1..20: mol_type = other DNA
tcctccttctatgcagcctg

SEQ ID NO: 1130 - DNA, 20 bp, synthetic construct
  source 1..20: mol_type = other DNA
catcacagtctggttaccag

SEQ ID NO: 1131 - DNA, 20 bp, synthetic construct
  source 1..20: mol_type = other DNA
ccagcaactgctgctcctca

SEQ ID NO: 1132 - DNA, 20 bp, synthetic construct
  source 1..20: mol_type = other DNA
gcacagagactgcctatact

SEQ ID NO: 1133 - DNA, 20 bp, synthetic construct
  source 1..20: mol_type = other DNA
acatactggaaggcatggat

SEQ ID NO: 1134 - DNA, 20 bp, synthetic construct
  source 1..20: mol_type = other DNA
tgtgagtttgattcaagaag

SEQ ID NO: 1135 - DNA, 20 bp, synthetic construct
  source 1..20: mol_type = other DNA
ttcaattagagcctccattc

SEQ ID NO: 1136 - DNA, 20 bp, synthetic construct
  source 1..20: mol_type = other DNA
aaggtacggattacttcact

SEQ ID NO: 1137 - DNA, 20 bp, synthetic construct
  source 1..20: mol_type = other DNA
gagtccaaagagagacctta

SEQ ID NO: 1138 - DNA, 20 bp, synthetic construct
  source 1..20: mol_type = other DNA
caaactctttctgcctgtcc

SEQ ID NO: 1139 - DNA, 20 bp, synthetic construct
  source 1..20: mol_type = other DNA
aaatacactttgtaagataa

SEQ ID NO: 1140 - DNA, 20 bp, synthetic construct
  source 1..20: mol_type = other DNA
atgggtttggagactatatt

SEQ ID NO: 1141 - DNA, 20 bp, synthetic construct
  source 1..20: mol_type = other DNA
ttaacaaaaacaggaaaaga

SEQ ID NO: 1142 - DNA, 20 bp, synthetic construct
  source 1..20: mol_type = other DNA
tacaacaaaagaactgtagt

SEQ ID NO: 1143 - DNA, 20 bp, synthetic construct
  source 1..20: mol_type = other DNA
ggtaatagagagaccagaat

SEQ ID NO: 1144 - DNA, 20 bp, synthetic construct
  source 1..20: mol_type = other DNA
ctcttaacacaccaagataa

SEQ ID NO: 1145 - DNA, 20 bp, synthetic construct
  source 1..20: mol_type = other DNA
aaatgtacttattttacctc

SEQ ID NO: 1146 - DNA, 20 bp, synthetic construct
  source 1..20: mol_type = other DNA
agctatgaagcaaaatgact

SEQ ID NO: 1147 - DNA, 20 bp, synthetic construct
  source 1..20: mol_type = other DNA
aagtaaaatcattttccatt

SEQ ID NO: 1148 - DNA, 20 bp, synthetic construct
  source 1..20: mol_type = other DNA
aatgagcaccattgtgaaga

SEQ ID NO: 1149 - DNA, 20 bp, synthetic construct
  source 1..20: mol_type = other DNA
aataggcagatttgggcaaa

SEQ ID NO: 1150 - DNA, 20 bp, synthetic construct
  source 1..20: mol_type = other DNA
ctcactatatgcccagcatt

SEQ ID NO: 1151 - DNA, 20 bp, synthetic construct
  source 1..20: mol_type = other DNA
gagaaaataacctttatgtt

SEQ ID NO: 1152 - DNA, 20 bp, synthetic construct
  source 1..20: mol_type = other DNA
gcatcaagcaagcagttatt

SEQ ID NO: 1153 - DNA, 20 bp, synthetic construct
  source 1..20: mol_type = other DNA
ggcagaatacttgtagaaaa

SEQ ID NO: 1154 - DNA, 20 bp, synthetic construct
  source 1..20: mol_type = other DNA
caaatcaagaccttcaaatc

SEQ ID NO: 1155 - DNA, 20 bp, synthetic construct
  source 1..20: mol_type = other DNA
gatgggagacgcagcattgt

SEQ ID NO: 1156 - DNA, 20 bp, synthetic construct
  source 1..20: mol_type = other DNA
gtgggtgaaagatccttgct

SEQ ID NO: 1157 - DNA, 20 bp, synthetic construct
  source 1..20: mol_type = other DNA
gaggaccaaagacattcctt

SEQ ID NO: 1158 - DNA, 20 bp, synthetic construct
  source 1..20: mol_type = other DNA
aaaaaacagtcataatcaaa

SEQ ID NO: 1159 - DNA, 20 bp, synthetic construct
  source 1..20: mol_type = other DNA
ttccctaacgaggtgtaagg

SEQ ID NO: 1160 - DNA, 20 bp, synthetic construct
  source 1..20: mol_type = other DNA
actgcctatactggcagagg

SEQ ID NO: 1161 - DNA, 20 bp, synthetic construct
  source 1..20: mol_type = other DNA
ctggaatacatgaaatgtgc

SEQ ID NO: 1162 - DNA, 20 bp, synthetic construct
  source 1..20: mol_type = other DNA
aaactctttctgcctgtcct

SEQ ID NO: 1163 - DNA, 20 bp, synthetic construct
  source 1..20: mol_type = other DNA
attcaaattcaccaaatctg

SEQ ID NO: 1164 - DNA, 20 bp, synthetic construct
  source 1..20: mol_type = other DNA
agaaaataacctttatgtta

SEQ ID NO: 1165 - DNA, 20 bp, synthetic construct
  source 1..20: mol_type = other DNA
ttgtatacaaactcccaaaa

SEQ ID NO: 1166 - DNA, 20 bp, synthetic construct
  source 1..20: mol_type = other DNA
cagaaatgaaggaaacactt

SEQ ID NO: 1167 - DNA, 20 bp, synthetic construct
  source 1..20: mol_type = other DNA
attttgtacatctgagggct

SEQ ID NO: 1168 - DNA, 20 bp, synthetic construct
  source 1..20: mol_type = other DNA
aagaacgatcagattactca

SEQ ID NO: 1169 - DNA, 20 bp, synthetic construct
  source 1..20: mol_type = other DNA
tgggtgaaagatccttgctt

SEQ ID NO: 1170 - DNA, 20 bp, synthetic construct
  source 1..20: mol_type = other DNA
tgatctagcactgagttttc

SEQ ID NO: 1171 - DNA, 20 bp, synthetic construct
  source 1..20: mol_type = other DNA
gtctggttaccagggtaaca

SEQ ID NO: 1172 - DNA, 20 bp, synthetic construct
  source 1..20: mol_type = other DNA
ttcagataaatcacttcacc

SEQ ID NO: 1173 - DNA, 20 bp, synthetic construct
  source 1..20: mol_type = other DNA
agacatgctatccaaagagt

SEQ ID NO: 1174 - DNA, 20 bp, synthetic construct
  source 1..20: mol_type = other DNA
gctacaaacagactttatac

SEQ ID NO: 1175 - DNA, 20 bp, synthetic construct
  source 1..20: mol_type = other DNA
tgttgttctcagaaaacatt

SEQ ID NO: 1176 - DNA, 20 bp, synthetic construct
  source 1..20: mol_type = other DNA
tttccatcagtggaagtacc

SEQ ID NO: 1177 - DNA, 20 bp, synthetic construct
  source 1..20: mol_type = other DNA
gggccagttggtggcaaagg

SEQ ID NO: 1178 - DNA, 20 bp, synthetic construct
  source 1..20: mol_type = other DNA
agtttgattcaagaaggctg

SEQ ID NO: 1179 - DNA, 20 bp, synthetic construct
  source 1..20: mol_type = other DNA
atgagcaccattgtgaagat

SEQ ID NO: 1180 - DNA, 20 bp, synthetic construct
  source 1..20: mol_type = other DNA
ttctgagtcaccagatcata

SEQ ID NO: 1181 - DNA, 20 bp, synthetic construct
  source 1..20: mol_type = other DNA
ctgatgactggtgcattctg

SEQ ID NO: 1182 - DNA, 20 bp, synthetic construct
  source 1..20: mol_type = other DNA
ccagtaggtagctcatgcca

SEQ ID NO: 1183 - DNA, 20 bp, synthetic construct
  source 1..20: mol_type = other DNA
gctatgaagcaaaatgacta

SEQ ID NO: 1184 - DNA, 20 bp, synthetic construct
  source 1..20: mol_type = other DNA
ccaggctatagcaagtcatg

SEQ ID NO: 1185 - DNA, 20 bp, synthetic construct
  source 1..20: mol_type = other DNA
tttgaaaacaagtatcaagt

SEQ ID NO: 1186 - DNA, 20 bp, synthetic construct
  source 1..20: mol_type = other DNA
ggcatggatcctgcattaac

SEQ ID NO: 1187 - DNA, 20 bp, synthetic construct
  source 1..20: mol_type = other DNA
actttctgatcctcaggaga

SEQ ID NO: 1188 - DNA, 20 bp, synthetic construct
  source 1..20: mol_type = other DNA
tactcagcaaatgtactggg

SEQ ID NO: 1189 - DNA, 20 bp, synthetic construct
  source 1..20: mol_type = other DNA
aatacactttgtaagataag

SEQ ID NO: 1190 - DNA, 20 bp, synthetic construct
  source 1..20: mol_type = other DNA
agtccaaagagagaccttaa

SEQ ID NO: 1191 - DNA, 20 bp, synthetic construct
  source 1..20: mol_type = other DNA
ccttctatgcagcctggaag

SEQ ID NO: 1192 - DNA, 20 bp, synthetic construct
  source 1..20: mol_type = other DNA
ttaaggacggcaaagttgta

SEQ ID NO: 1193 - DNA, 20 bp, synthetic construct
  source 1..20: mol_type = other DNA
gaagggttggttatttgtta

SEQ ID NO: 1194 - DNA, 20 bp, synthetic construct
  source 1..20: mol_type = other DNA
tcaattagagcctccattcc

SEQ ID NO: 1195 - DNA, 20 bp, synthetic construct
  source 1..20: mol_type = other DNA
tagattcaactagccaattt

SEQ ID NO: 1196 - DNA, 20 bp, synthetic construct
  source 1..20: mol_type = other DNA
ataggcagatttgggcaaac

SEQ ID NO: 1197 - DNA, 20 bp, synthetic construct
  source 1..20: mol_type = other DNA
aagagaatatatttggcccc

SEQ ID NO: 1198 - DNA, 20 bp, synthetic construct
  source 1..20: mol_type = other DNA
tttgtgatgcttaatgtcca

SEQ ID NO: 1199 - DNA, 20 bp, synthetic construct
  source 1..20: mol_type = other DNA
ggccagagtacacaactaat

SEQ ID NO: 1200 - DNA, 20 bp, synthetic construct
  source 1..20: mol_type = other DNA
gggccatctcaggttacacc

SEQ ID NO: 1201 - DNA, 20 bp, synthetic construct
  source 1..20: mol_type = other DNA
tgtgtgttaaaattgcaatt

SEQ ID NO: 1202 - DNA, 20 bp, synthetic construct
  source 1..20: mol_type = other DNA
agtaaaatcattttccatta

SEQ ID NO: 1203 - DNA, 20 bp, synthetic construct
  source 1..20: mol_type = other DNA
aaaaacagtcataatcaaag

SEQ ID NO: 1204 - DNA, 20 bp, synthetic construct
  source 1..20: mol_type = other DNA
aaatcaagaccttcaaatca

SEQ ID NO: 1205 - DNA, 20 bp, synthetic construct
  source 1..20: mol_type = other DNA
tcttaacacaccaagataac

SEQ ID NO: 1206 - DNA, 20 bp, synthetic construct
  source 1..20: mol_type = other DNA
acaaaaacaggaaaagactg

SEQ ID NO: 1207 - DNA, 20 bp, synthetic construct
  source 1..20: mol_type = other DNA
ccttggaaaccacagggttg

SEQ ID NO: 1208 - DNA, 20 bp, synthetic construct
  source 1..20: mol_type = other DNA
ggagaagggagtgagaagat

SEQ ID NO: 1209 - DNA, 20 bp, synthetic construct
  source 1..20: mol_type = other DNA
atgggagacgcagcattgta

SEQ ID NO: 1210 - DNA, 20 bp, synthetic construct
  source 1..20: mol_type = other DNA
ccttaaatattgctgaaacc

SEQ ID NO: 1211 - DNA, 20 bp, synthetic construct
  source 1..20: mol_type = other DNA
cctgaacacatgcttcaaag

SEQ ID NO: 1212 - DNA, 20 bp, synthetic construct
  source 1..20: mol_type = other DNA
gaaaactcagtggctgctcc

SEQ ID NO: 1213 - DNA, 20 bp, synthetic construct
  source 1..20: mol_type = other DNA
gggcatttaagttcagcaga

SEQ ID NO: 1214 - DNA, 20 bp, synthetic construct
  source 1..20: mol_type = other DNA
ttaggcatttcccatttcta

SEQ ID NO: 1215 - DNA, 20 bp, synthetic construct
  source 1..20: mol_type = other DNA
tcactatatgcccagcatta

SEQ ID NO: 1216 - DNA, 20 bp, synthetic construct
  source 1..20: mol_type = other DNA
gagacaatagtagccatacc

SEQ ID NO: 1217 - DNA, 20 bp, synthetic construct
  source 1..20: mol_type = other DNA
gtaatagagagaccagaatg

SEQ ID NO: 1218 - DNA, 20 bp, synthetic construct
  source 1..20: mol_type = other DNA
caactgctgctcctcaggcc

SEQ ID NO: 1219 - DNA, 20 bp, synthetic construct
  source 1..20: mol_type = other DNA
acttattttacctctcattt

SEQ ID NO: 1220 - DNA, 20 bp, synthetic construct
  source 1..20: mol_type = other DNA
cctgcctataatcttgtctt

SEQ ID NO: 1221 - DNA, 20 bp, synthetic construct
  source 1..20: mol_type = other DNA
tgactgaatggataataccc

SEQ ID NO: 1222 - DNA, 20 bp, synthetic construct
  source 1..20: mol_type = other DNA
gtttggagactatatttccc

SEQ ID NO: 1223 - DNA, 20 bp, synthetic construct
  source 1..20: mol_type = other DNA
ttcttgttacactcatcaag

SEQ ID NO: 1224 - DNA, 20 bp, synthetic construct
  source 1..20: mol_type = other DNA
ggaagcagtctaccttcttg

SEQ ID NO: 1225 - DNA, 20 bp, synthetic construct
  source 1..20: mol_type = other DNA
tgtatacacattattgtcta

SEQ ID NO: 1226 - DNA, 20 bp, synthetic construct
  source 1..20: mol_type = other DNA
acaacaaaagaactgtagta

SEQ ID NO: 1227 - DNA, 20 bp, synthetic construct
  source 1..20: mol_type = other DNA
tgaaggttggctcagacaac

SEQ ID NO: 1228 - DNA, 20 bp, synthetic construct
  source 1..20: mol_type = other DNA
ggctaattcaaaatccagca

SEQ ID NO: 1229 - DNA, 20 bp, synthetic construct
  source 1..20: mol_type = other DNA
ccagacatttctgatgcaac

SEQ ID NO: 1230 - DNA, 20 bp, synthetic construct
  source 1..20: mol_type = other DNA
aggaccaaagacattccttc

SEQ ID NO: 1231 - DNA, 20 bp, synthetic construct
  source 1..20: mol_type = other DNA
cttcaattaaaaccaatcag

SEQ ID NO: 1232 - DNA, 20 bp, synthetic construct
  source 1..20: mol_type = other DNA
cagaatacttgtagaaaatc

SEQ ID NO: 1233 - DNA, 20 bp, synthetic construct
  source 1..20: mol_type = other DNA
gctaattcaaaatccagcaa

SEQ ID NO: 1234 - DNA, 20 bp, synthetic construct
  source 1..20: mol_type = other DNA
acaagtctaatcaatctgtg

SEQ ID NO: 1235 - DNA, 20 bp, synthetic construct
  source 1..20: mol_type = other DNA
tcagataaatcacttcaccc

SEQ ID NO: 1236 - DNA, 20 bp, synthetic construct
  source 1..20: mol_type = other DNA
ccagcattatgctgggtgtt

SEQ ID NO: 1237 - DNA, 20 bp, synthetic construct
  source 1..20: mol_type = other DNA
gtaaaatcattttccattag

SEQ ID NO: 1238 - DNA, 20 bp, synthetic construct
  source 1..20: mol_type = other DNA
gtgtgttaaaattgcaattc

SEQ ID NO: 1239 - DNA, 20 bp, synthetic construct
  source 1..20: mol_type = other DNA
tttctgatcctcaggagatg

SEQ ID NO: 1240 - DNA, 20 bp, synthetic construct
  source 1..20: mol_type = other DNA
ctgcctatactggcagaggt

SEQ ID NO: 1241 - DNA, 20 bp, synthetic construct
  source 1..20: mol_type = other DNA
tatttgttatgttattaaat

SEQ ID NO: 1242 - DNA, 20 bp, synthetic construct
  source 1..20: mol_type = other DNA
agactttatacaaagtcagc

SEQ ID NO: 1243 - DNA, 20 bp, synthetic construct
  source 1..20: mol_type = other DNA
cagacatttctgatgcaacc

SEQ ID NO: 1244 - DNA, 20 bp, synthetic construct
  source 1..20: mol_type = other DNA
aatcaagaccttcaaatcac

SEQ ID NO: 1245 - DNA, 20 bp, synthetic construct
  source 1..20: mol_type = other DNA
gaacacatgcttcaaagtgt

SEQ ID NO: 1246 - DNA, 20 bp, synthetic construct
  source 1..20: mol_type = other DNA
caacaaaagaactgtagtac

SEQ ID NO: 1247 - DNA, 20 bp, synthetic construct
  source 1..20: mol_type = other DNA
gtccaaagagagaccttaat

SEQ ID NO: 1248 - DNA, 20 bp, synthetic construct
  source 1..20: mol_type = other DNA
cctgtcctttttcctggaag

SEQ ID NO: 1249 - DNA, 20 bp, synthetic construct
  source 1..20: mol_type = other DNA
agaaatgaaggaaacacttt

SEQ ID NO: 1250 - DNA, 20 bp, synthetic construct
  source 1..20: mol_type = other DNA
ctgctgctcctcaggccagt

SEQ ID NO: 1251 - DNA, 20 bp, synthetic construct
  source 1..20: mol_type = other DNA
aggcatttcccatttctagc

SEQ ID NO: 1252 - DNA, 20 bp, synthetic construct
  source 1..20: mol_type = other DNA
cttaacacaccaagataaca

SEQ ID NO: 1253 - DNA, 20 bp, synthetic construct
  source 1..20: mol_type = other DNA
taggcagatttgggcaaacg

SEQ ID NO: 1254 - DNA, 20 bp, synthetic construct
  source 1..20: mol_type = other DNA
ggaccaaagacattccttct

SEQ ID NO: 1255 - DNA, 20 bp, synthetic construct
  source 1..20: mol_type = other DNA
gagaagggagtgagaagatg

SEQ ID NO: 1256 - DNA, 20 bp, synthetic construct
  source 1..20: mol_type = other DNA
cacttatataccacattcaa

SEQ ID NO: 1257 - DNA, 20 bp, synthetic construct
  source 1..20: mol_type = other DNA
aactcagtggctgctccatc

SEQ ID NO: 1258 - DNA, 20 bp, synthetic construct
  source 1..20: mol_type = other DNA
gccagagtacacaactaatt

SEQ ID NO: 1259 - DNA, 20 bp, synthetic construct
  source 1..20: mol_type = other DNA
tgggagacgcagcattgtag

SEQ ID NO: 1260 - DNA, 20 bp, synthetic construct
  source 1..20: mol_type = other DNA
gcaaatgtactgggaagctg

SEQ ID NO: 1261 - DNA, 20 bp, synthetic construct
  source 1..20: mol_type = other DNA
cttaaatattgctgaaacca

SEQ ID NO: 1262 - DNA, 20 bp, synthetic construct
  source 1..20: mol_type = other DNA
tgagtcaccagatcatagcc

SEQ ID NO: 1263 - DNA, 20 bp, synthetic construct
  source 1..20: mol_type = other DNA
tcttgttacactcatcaagt

SEQ ID NO: 1264 - DNA, 20 bp, synthetic construct
  source 1..20: mol_type = other DNA
ctatgaagcaaaatgactaa

SEQ ID NO: 1265 - DNA, 20 bp, synthetic construct
  source 1..20: mol_type = other DNA
ggacacatgaccacatccat

SEQ ID NO: 1266 - DNA, 20 bp, synthetic construct
  source 1..20: mol_type = other DNA
ttgagataaagaagttccaa

SEQ ID NO: 1267 - DNA, 20 bp, synthetic construct
  source 1..20: mol_type = other DNA
gcatttaagttcagcagaag

SEQ ID NO: 1268 - DNA, 20 bp, synthetic construct
  source 1..20: mol_type = other DNA
gacaatagtagccatacctt

SEQ ID NO: 1269 - DNA, 20 bp, synthetic construct
  source 1..20: mol_type = other DNA
gaaaataacctttatgttaa

SEQ ID NO: 1270 - DNA, 20 bp, synthetic construct
  source 1..20: mol_type = other DNA
agactatatttcccctccca

SEQ ID NO: 1271 - DNA, 20 bp, synthetic construct
  source 1..20: mol_type = other DNA
gcatggatcctgcattaaca

SEQ ID NO: 1272 - DNA, 20 bp, synthetic construct
  source 1..20: mol_type = other DNA
ggccagttggtggcaaaggc

SEQ ID NO: 1273 - DNA, 20 bp, synthetic construct
  source 1..20: mol_type = other DNA
gcagtctaccttcttgcctt

SEQ ID NO: 1274 - DNA, 20 bp, synthetic construct
  source 1..20: mol_type = other DNA
acactttgtaagataagttt

SEQ ID NO: 1275 - DNA, 20 bp, synthetic construct
  source 1..20: mol_type = other DNA
cttggaaaccacagggttgt

SEQ ID NO: 1276 - DNA, 20 bp, synthetic construct
  source 1..20: mol_type = other DNA
tccatcagtggaagtaccct

SEQ ID NO: 1277 - DNA, 20 bp, synthetic construct
  source 1..20: mol_type = other DNA
tgatgactggtgcattctgt

SEQ ID NO: 1278 - DNA, 20 bp, synthetic construct
  source 1..20: mol_type = other DNA
caggctatagcaagtcatgt

SEQ ID NO: 1279 - DNA, 20 bp, synthetic construct
  source 1..20: mol_type = other DNA
ttcaaattcaccaaatctgt

SEQ ID NO: 1280 - DNA, 20 bp, synthetic construct
  source 1..20: mol_type = other DNA
tgttctcagaaaacattcca

SEQ ID NO: 1281 - DNA, 20 bp, synthetic construct
  source 1..20: mol_type = other DNA
tggaatacatgaaatgtgca

SEQ ID NO: 1282 - DNA, 20 bp, synthetic construct
  source 1..20: mol_type = other DNA
aaaacagtcataatcaaaga

SEQ ID NO: 1283 - DNA, 20 bp, synthetic construct
  source 1..20: mol_type = other DNA
tctggttaccagggtaacag

SEQ ID NO: 1284 - DNA, 20 bp, synthetic construct
  source 1..20: mol_type = other DNA
caattagagcctccattcct

SEQ ID NO: 1285 - DNA, 20 bp, synthetic construct
  source 1..20: mol_type = other DNA
agattcaactagccaatttt

SEQ ID NO: 1286 - DNA, 20 bp, synthetic construct
  source 1..20: mol_type = other DNA
gacatgctatccaaagagtt

SEQ ID NO: 1287 - DNA, 20 bp, synthetic construct
  source 1..20: mol_type = other DNA
aaggacggcaaagttgtaag

SEQ ID NO: 1288 - DNA, 20 bp, synthetic construct
  source 1..20: mol_type = other DNA
ggttggctcagacaacttct

SEQ ID NO: 1289 - DNA, 20 bp, synthetic construct
  source 1..20: mol_type = other DNA
tgagcaccattgtgaagata

SEQ ID NO: 1290 - DNA, 20 bp, synthetic construct
  source 1..20: mol_type = other DNA
gggtgaaagatccttgcttt

SEQ ID NO: 1291 - DNA, 20 bp, synthetic construct
  source 1..20: mol_type = other DNA
gagaagttccttggctctct

SEQ ID NO: 1292 - DNA, 20 bp, synthetic construct
  source 1..20: mol_type = other DNA
agagaatatatttggcccct

SEQ ID NO: 1293 - DNA, 20 bp, synthetic construct
  source 1..20: mol_type = other DNA
gtgatgcttaatgtccaatt

SEQ ID NO: 1294 - DNA, 20 bp, synthetic construct
  source 1..20: mol_type = other DNA
ttcaattaaaaccaatcaga

SEQ ID NO: 1295 - DNA, 20 bp, synthetic construct
  source 1..20: mol_type = other DNA
gccatctcaggttacaccat

SEQ ID NO: 1296 - DNA, 20 bp, synthetic construct
  source 1..20: mol_type = other DNA
gggataccaacagatggctt

SEQ ID NO: 1297 - DNA, 20 bp, synthetic construct
  source 1..20: mol_type = other DNA
ctagcactgagttttcctca

SEQ ID NO: 1298 - DNA, 20 bp, synthetic construct
  source 1..20: mol_type = other DNA
taatagagagaccagaatga

SEQ ID NO: 1299 - DNA, 20 bp, synthetic construct
  source 1..20: mol_type = other DNA
caggaaaagactgaaatctg

SEQ ID NO: 1300 - DNA, 20 bp, synthetic construct
  source 1..20: mol_type = other DNA
ctgtaagtaaggttggctga

SEQ ID NO: 1301 - DNA, 20 bp, synthetic construct
  source 1..20: mol_type = other DNA
gtatacacattattgtctaa

SEQ ID NO: 1302 - DNA, 20 bp, synthetic construct
  source 1..20: mol_type = other DNA
ttgaaaacaagtatcaagtg

SEQ ID NO: 1303 - DNA, 20 bp, synthetic construct
  source 1..20: mol_type = other DNA
cttctatgcagcctggaagc

SEQ ID NO: 1304 - DNA, 20 bp, synthetic construct
  source 1..20: mol_type = other DNA
agaatacttgtagaaaatcc

SEQ ID NO: 1305 - DNA, 20 bp, synthetic construct
  source 1..20: mol_type = other DNA
cagtaggtagctcatgccac

SEQ ID NO: 1306 - DNA, 20 bp, synthetic construct
  source 1..20: mol_type = other DNA
agaacgatcagattactcaa

SEQ ID NO: 1307 - DNA, 20 bp, synthetic construct
  source 1..20: mol_type = other DNA
aacaaaagaactgtagtaca

SEQ ID NO: 1308 - DNA, 20 bp, synthetic construct
  source 1..20: mol_type = other DNA
ggaatacatgaaatgtgcat

SEQ ID NO: 1309 - DNA, 20 bp, synthetic construct
  source 1..20: mol_type = other DNA
gctgctatttttgaataagc

SEQ ID NO: 1310 - DNA, 20 bp, synthetic construct
  source 1..20: mol_type = other DNA
tggctcagacaacttctaaa

SEQ ID NO: 1311 - DNA, 20 bp, synthetic construct
  source 1..20: mol_type = other DNA
gcactgagttttcctcaggg

SEQ ID NO: 1312 - DNA, 20 bp, synthetic construct
  source 1..20: mol_type = other DNA
ctgatcctcaggagatgctt

SEQ ID NO: 1313 - DNA, 20 bp, synthetic construct
  source 1..20: mol_type = other DNA
ttaaatattgctgaaaccac

SEQ ID NO: 1314 - DNA, 20 bp, synthetic construct
  source 1..20: mol_type = other DNA
gattcaactagccaattttt

SEQ ID NO: 1315 - DNA, 20 bp, synthetic construct
  source 1..20: mol_type = other DNA
cagcagaagtgaagaatctc

SEQ ID NO: 1316 - DNA, 20 bp, synthetic construct
  source 1..20: mol_type = other DNA
gactatatttcccctcccac

SEQ ID NO: 1317 - DNA, 20 bp, synthetic construct
  source 1..20: mol_type = other DNA
tacacattattgtctaatag

SEQ ID NO: 1318 - DNA, 20 bp, synthetic construct
  source 1..20: mol_type = other DNA
cctaacgaggtgtaaggcca

SEQ ID NO: 1319 - DNA, 20 bp, synthetic construct
  source 1..20: mol_type = other DNA
gaccaaagacattccttctc

SEQ ID NO: 1320 - DNA, 20 bp, synthetic construct
  source 1..20: mol_type = other DNA
ctgctcctcaggccagtctg

SEQ ID NO: 1321 - DNA, 20 bp, synthetic construct
  source 1..20: mol_type = other DNA
taaaatcattttccattagc

SEQ ID NO: 1322 - DNA, 20 bp, synthetic construct
  source 1..20: mol_type = other DNA
tcaattaaaaccaatcagac

SEQ ID NO: 1323 - DNA, 20 bp, synthetic construct
  source 1..20: mol_type = other DNA
aggcagatttgggcaaacgc

SEQ ID NO: 1324 - DNA, 20 bp, synthetic construct
  source 1..20: mol_type = other DNA
acatgctatccaaagagtta

SEQ ID NO: 1325 - DNA, 20 bp, synthetic construct
  source 1..20: mol_type = other DNA
tatgaagcaaaatgactaaa

SEQ ID NO: 1326 - DNA, 20 bp, synthetic construct
  source 1..20: mol_type = other DNA
cactttgtaagataagtttc

SEQ ID NO: 1327 - DNA, 20 bp, synthetic construct
  source 1..20: mol_type = other DNA
aattagagcctccattcctt

SEQ ID NO: 1328 - DNA, 20 bp, synthetic construct
  source 1..20: mol_type = other DNA
ttaacacaccaagataacat

SEQ ID NO: 1329 - DNA, 20 bp, synthetic construct
  source 1..20: mol_type = other DNA
tccaaagagagaccttaatc

SEQ ID NO: 1330 - DNA, 20 bp, synthetic construct
  source 1..20: mol_type = other DNA
gttctcagaaaacattccag

SEQ ID NO: 1331 - DNA, 20 bp, synthetic construct
  source 1..20: mol_type = other DNA
cctgcattaacaggtagaca

SEQ ID NO: 1332 - DNA, 20 bp, synthetic construct
  source 1..20: mol_type = other DNA
tttgttatgttattaaatca

SEQ ID NO: 1333 - DNA, 20 bp, synthetic construct
  source 1..20: mol_type = other DNA
ccttcttgcctttcagaata

SEQ ID NO: 1334 - DNA, 20 bp, synthetic construct
  source 1..20: mol_type = other DNA
gactttatacaaagtcagca

SEQ ID NO: 1335 - DNA, 20 bp, synthetic construct
  source 1..20: mol_type = other DNA
attgcaaattgatctctgtg

SEQ ID NO: 1336 - DNA, 20 bp, synthetic construct
  source 1..20: mol_type = other DNA
ccagagtacacaactaatta

SEQ ID NO: 1337 - DNA, 20 bp, synthetic construct
  source 1..20: mol_type = other DNA
tgtaagtaaggttggctgag

SEQ ID NO: 1338 - DNA, 20 bp, synthetic construct
  source 1..20: mol_type = other DNA
ccatcagtggaagtaccctt

SEQ ID NO: 1339 - DNA, 20 bp, synthetic construct
  source 1..20: mol_type = other DNA
gccagttggtggcaaaggca

SEQ ID NO: 1340 - DNA, 20 bp, synthetic construct
  source 1..20: mol_type = other DNA
ggctatagcaagtcatgttt

SEQ ID NO: 1341 - DNA, 20 bp, synthetic construct
  source 1..20: mol_type = other DNA
tgtgttaaaattgcaattct

SEQ ID NO: 1342 - DNA, 20 bp, synthetic construct
  source 1..20: mol_type = other DNA
gacacatgaccacatccatc

SEQ ID NO: 1343 - DNA, 20 bp, synthetic construct
  source 1..20: mol_type = other DNA
gcaccattgtgaagatatga

SEQ ID NO: 1344 - DNA, 20 bp, synthetic construct
  source 1..20: mol_type = other DNA
cttgttacactcatcaagta

SEQ ID NO: 1345 - DNA, 20 bp, synthetic construct
  source 1..20: mol_type = other DNA
tgttgaagtaaatgtacaca

SEQ ID NO: 1346 - DNA, 20 bp, synthetic construct
  source 1..20: mol_type = other DNA
ggacggcaaagttgtaagtg

SEQ ID NO: 1347 - DNA, 20 bp, synthetic construct
  source 1..20: mol_type = other DNA
aggaaaagactgaaatctgg

SEQ ID NO: 1348 - DNA, 20 bp, synthetic construct
  source 1..20: mol_type = other DNA
agaagggagtgagaagatgc

SEQ ID NO: 1349 - DNA, 20 bp, synthetic construct
  source 1..20: mol_type = other DNA
tggaaaccacagggttgtca

SEQ ID NO: 1350 - DNA, 20 bp, synthetic construct
  source 1..20: mol_type = other DNA
aaacagtcataatcaaagaa

SEQ ID NO: 1351 - DNA, 20 bp, synthetic construct
  source 1..20: mol_type = other DNA
gaaaacaagtatcaagtgtc

SEQ ID NO: 1352 - DNA, 20 bp, synthetic construct
  source 1..20: mol_type = other DNA
gaaatgaaggaaacactttc

SEQ ID NO: 1353 - DNA, 20 bp, synthetic construct
  source 1..20: mol_type = other DNA
ggattacttcactgtccttt

SEQ ID NO: 1354 - DNA, 20 bp, synthetic construct
  source 1..20: mol_type = other DNA
ccatctcaggttacaccatt

SEQ ID NO: 1355 - DNA, 20 bp, synthetic construct
  source 1..20: mol_type = other DNA
aaaacctatgaatgcctctg

SEQ ID NO: 1356 - DNA, 20 bp, synthetic construct
  source 1..20: mol_type = other DNA
ttggctttcagcatgtgaga

SEQ ID NO: 1357 - DNA, 20 bp, synthetic construct
  source 1..20: mol_type = other DNA
gcatttcccatttctagcag

SEQ ID NO: 1358 - DNA, 20 bp, synthetic construct
  source 1..20: mol_type = other DNA
tgatgcttaatgtccaattt

SEQ ID NO: 1359 - DNA, 20 bp, synthetic construct
  source 1..20: mol_type = other DNA
acaatagtagccataccttg

SEQ ID NO: 1360 - DNA, 20 bp, synthetic construct
  source 1..20: mol_type = other DNA
actgaatggataatacccca

SEQ ID NO: 1361 - DNA, 20 bp, synthetic construct
  source 1..20: mol_type = other DNA
gaatacttgtagaaaatccc

SEQ ID NO: 1362 - DNA, 20 bp, synthetic construct
  source 1..20: mol_type = other DNA
gtgaaagatccttgctttga

SEQ ID NO: 1363 - DNA, 20 bp, synthetic construct
  source 1..20: mol_type = other DNA
ctgtcctttttcctggaagc

SEQ ID NO: 1364 - DNA, 20 bp, synthetic construct
  source 1..20: mol_type = other DNA
atcaagaccttcaaatcacc

SEQ ID NO: 1365 - DNA, 20 bp, synthetic construct
  source 1..20: mol_type = other DNA
gaacgatcagattactcaaa

SEQ ID NO: 1366 - DNA, 20 bp, synthetic construct
  source 1..20: mol_type = other DNA
aagtctaatcaatctgtgat

SEQ ID NO: 1367 - DNA, 20 bp, synthetic construct
  source 1..20: mol_type = other DNA
gagaatatatttggccccta

SEQ ID NO: 1368 - DNA, 20 bp, synthetic construct
  source 1..20: mol_type = other DNA
aaatcacttcacccttcagt

SEQ ID NO: 1369 - DNA, 20 bp, synthetic construct
  source 1..20: mol_type = other DNA
aaataacctttatgttaaac

SEQ ID NO: 1370 - DNA, 20 bp, synthetic construct
  source 1..20: mol_type = other DNA
ggataccaacagatggctta

SEQ ID NO: 1371 - DNA, 20 bp, synthetic construct
  source 1..20: mol_type = other DNA
atggtattagctactccctt

SEQ ID NO: 1372 - DNA, 20 bp, synthetic construct
  source 1..20: mol_type = other DNA
tcaaattcaccaaatctgtt

SEQ ID NO: 1373 - DNA, 20 bp, synthetic construct
  source 1..20: mol_type = other DNA
gacatttctgatgcaacccc

SEQ ID NO: 1374 - DNA, 20 bp, synthetic construct
  source 1..20: mol_type = other DNA
ccatcatatgtacctggccc

SEQ ID NO: 1375 - DNA, 20 bp, synthetic construct
  source 1..20: mol_type = other DNA
tctatgcagcctggaagctt

SEQ ID NO: 1376 - DNA, 20 bp, synthetic construct
  source 1..20: mol_type = other DNA
ggttaccagggtaacagcca

SEQ ID NO: 1377 - DNA, 20 bp, synthetic construct
  source 1..20: mol_type = other DNA
gagtctttaatttcctgagg

SEQ ID NO: 1378 - DNA, 20 bp, synthetic construct
  source 1..20: mol_type = other DNA
tcaccagatcatagcctttc

SEQ ID NO: 1379 - DNA, 20 bp, synthetic construct
  source 1..20: mol_type = other DNA
acttatataccacattcaag

SEQ ID NO: 1380 - DNA, 20 bp, synthetic construct
  source 1..20: mol_type = other DNA
aatagagagaccagaatgaa

SEQ ID NO: 1381 - DNA, 20 bp, synthetic construct
  source 1..20: mol_type = other DNA
ctctcaagagacattctcac

SEQ ID NO: 1382 - DNA, 20 bp, synthetic construct
  source 1..20: mol_type = other DNA
atagagagaccagaatgaat

SEQ ID NO: 1383 - DNA, 20 bp, synthetic construct
  source 1..20: mol_type = other DNA
acaaaagaactgtagtacaa

SEQ ID NO: 1384 - DNA, 20 bp, synthetic construct
  source 1..20: mol_type = other DNA
agcagaagtgaagaatctca

SEQ ID NO: 1385 - DNA, 20 bp, synthetic construct
  source 1..20: mol_type = other DNA
tctgcacaatgagcacacta

SEQ ID NO: 1386 - DNA, 20 bp, synthetic construct
  source 1..20: mol_type = other DNA
atttacagttgttatagatc

SEQ ID NO: 1387 - DNA, 20 bp, synthetic construct
  source 1..20: mol_type = other DNA
tgaatggataataccccatg

SEQ ID NO: 1388 - DNA, 20 bp, synthetic construct
  source 1..20: mol_type = other DNA
ggaaaccacagggttgtcat

SEQ ID NO: 1389 - DNA, 20 bp, synthetic construct
  source 1..20: mol_type = other DNA
atctaactgaatgttaagga

SEQ ID NO: 1390 - DNA, 20 bp, synthetic construct
  source 1..20: mol_type = other DNA
gtaagtaaggttggctgagt

SEQ ID NO: 1391 - DNA, 20 bp, synthetic construct
  source 1..20: mol_type = other DNA
actttgtaagataagtttct

SEQ ID NO: 1392 - DNA, 20 bp, synthetic construct
  source 1..20: mol_type = other DNA
ttctcagaaaacattccaga

SEQ ID NO: 1393 - DNA, 20 bp, synthetic construct
  source 1..20: mol_type = other DNA
taaatattgctgaaaccact

SEQ ID NO: 1394 - DNA, 20 bp, synthetic construct
  source 1..20: mol_type = other DNA
tagccataccttgttcctca

SEQ ID NO: 1395 - DNA, 20 bp, synthetic construct
  source 1..20: mol_type = other DNA
cagagtacacaactaattaa

SEQ ID NO: 1396 - DNA, 20 bp, synthetic construct
  source 1..20: mol_type = other DNA
gttgaagtaaatgtacacag

SEQ ID NO: 1397 - DNA, 20 bp, synthetic construct
  source 1..20: mol_type = other DNA
tgttacactcatcaagtaag

SEQ ID NO: 1398 - DNA, 20 bp, synthetic construct
  source 1..20: mol_type = other DNA
gatgcttaatgtccaatttt

SEQ ID NO: 1399 - DNA, 20 bp, synthetic construct
  source 1..20: mol_type = other DNA
tgcaaattgatctctgtgga

SEQ ID NO: 1400 - DNA, 20 bp, synthetic construct
  source 1..20: mol_type = other DNA
caaattcaccaaatctgttt

SEQ ID NO: 1401 - DNA, 20 bp, synthetic construct
  source 1..20: mol_type = other DNA
tcaagagacattctcacatt

SEQ ID NO: 1402 - DNA, 20 bp, synthetic construct
  source 1..20: mol_type = other DNA
catgctatccaaagagttat

SEQ ID NO: 1403 - DNA, 20 bp, synthetic construct
  source 1..20: mol_type = other DNA
aaccgtaatttatgactgca

SEQ ID NO: 1404 - DNA, 20 bp, synthetic construct
  source 1..20: mol_type = other DNA
ggaaaagactgaaatctggg

SEQ ID NO: 1405 - DNA, 20 bp, synthetic construct
  source 1..20: mol_type = other DNA
caattaaaaccaatcagact

SEQ ID NO: 1406 - DNA, 20 bp, synthetic construct
  source 1..20: mol_type = other DNA
accaaagacattccttctct

SEQ ID NO: 1407 - DNA, 20 bp, synthetic construct
  source 1..20: mol_type = other DNA
aaaatcattttccattagct

SEQ ID NO: 1408 - DNA, 20 bp, synthetic construct
  source 1..20: mol_type = other DNA
tgaaagatccttgctttgac

SEQ ID NO: 1409 - DNA, 20 bp, synthetic construct
  source 1..20: mol_type = other DNA
gataccaacagatggcttag

SEQ ID NO: 1410 - DNA, 20 bp, synthetic construct
  source 1..20: mol_type = other DNA
attcaactagccaattttta

SEQ ID NO: 1411 - DNA, 20 bp, synthetic construct
  source 1..20: mol_type = other DNA
tcatatgtacctggcccaag

SEQ ID NO: 1412 - DNA, 20 bp, synthetic construct
  source 1..20: mol_type = other DNA
caccagatcatagcctttct

SEQ ID NO: 1413 - DNA, 20 bp, synthetic construct
  source 1..20: mol_type = other DNA
ctaacgaggtgtaaggccag

SEQ ID NO: 1414 - DNA, 20 bp, synthetic construct
  source 1..20: mol_type = other DNA
tcttgcctttcagaatagct

SEQ ID NO: 1415 - DNA, 20 bp, synthetic construct
  source 1..20: mol_type = other DNA
atataccacattcaagtgct

SEQ ID NO: 1416 - DNA, 20 bp, synthetic construct
  source 1..20: mol_type = other DNA
gttaccagggtaacagccac

SEQ ID NO: 1417 - DNA, 20 bp, synthetic construct
  source 1..20: mol_type = other DNA
aatacttgtagaaaatccca

SEQ ID NO: 1418 - DNA, 20 bp, synthetic construct
  source 1..20: mol_type = other DNA
tccaactttaagcccttctc

SEQ ID NO: 1419 - DNA, 20 bp, synthetic construct
  source 1..20: mol_type = other DNA
gaatatatttggcccctata

SEQ ID NO: 1420 - DNA, 20 bp, synthetic construct
  source 1..20: mol_type = other DNA
ccaaagagagaccttaatca

SEQ ID NO: 1421 - DNA, 20 bp, synthetic construct
  source 1..20: mol_type = other DNA
atgaaatgtgcatcattcta

SEQ ID NO: 1422 - DNA, 20 bp, synthetic construct
  source 1..20: mol_type = other DNA
catctcaggttacaccatta

SEQ ID NO: 1423 - DNA, 20 bp, synthetic construct
  source 1..20: mol_type = other DNA
acgctcttattgtttttctg

SEQ ID NO: 1424 - DNA, 20 bp, synthetic construct
  source 1..20: mol_type = other DNA
aacagtcataatcaaagaat

SEQ ID NO: 1425 - DNA, 20 bp, synthetic construct
  source 1..20: mol_type = other DNA
aaatgaaggaaacactttca

SEQ ID NO: 1426 - DNA, 20 bp, synthetic construct
  source 1..20: mol_type = other DNA
tgatcctcaggagatgcttg

SEQ ID NO: 1427 - DNA, 20 bp, synthetic construct
  source 1..20: mol_type = other DNA
actatatttcccctcccacc

SEQ ID NO: 1428 - DNA, 20 bp, synthetic construct
  source 1..20: mol_type = other DNA
atgaagcaaaatgactaaaa

SEQ ID NO: 1429 - DNA, 20 bp, synthetic construct
  source 1..20: mol_type = other DNA
gacggcaaagttgtaagtgg

SEQ ID NO: 1430 - DNA, 20 bp, synthetic construct
  source 1..20: mol_type = other DNA
cagttggtggcaaaggcaaa

SEQ ID NO: 1431 - DNA, 20 bp, synthetic construct
  source 1..20: mol_type = other DNA
agacgcagcattgtaggctg

SEQ ID NO: 1432 - DNA, 20 bp, synthetic construct
  source 1..20: mol_type = other DNA
ctgcattaacaggtagacaa

SEQ ID NO: 1433 - DNA, 20 bp, synthetic construct
  source 1..20: mol_type = other DNA
catttcccatttctagcagg

SEQ ID NO: 1434 - DNA, 20 bp, synthetic construct
  source 1..20: mol_type = other DNA
catcagtggaagtacccttt

SEQ ID NO: 1435 - DNA, 20 bp, synthetic construct
  source 1..20: mol_type = other DNA
gtgttaaaattgcaattcta

SEQ ID NO: 1436 - DNA, 20 bp, synthetic construct
  source 1..20: mol_type = other DNA
acccaaataacccactcacc

SEQ ID NO: 1437 - DNA, 20 bp, synthetic construct
  source 1..20: mol_type = other DNA
gaagggagtgagaagatgct

SEQ ID NO: 1438 - DNA, 20 bp, synthetic construct
  source 1..20: mol_type = other DNA
acatttctgatgcaacccca

SEQ ID NO: 1439 - DNA, 20 bp, synthetic construct
  source 1..20: mol_type = other DNA
acgatcagattactcaaatt

SEQ ID NO: 1440 - DNA, 20 bp, synthetic construct
  source 1..20: mol_type = other DNA
ctatgcagcctggaagctta

SEQ ID NO: 1441 - DNA, 20 bp, synthetic construct
  source 1..20: mol_type = other DNA
ggctcagacaacttctaaag

SEQ ID NO: 1442 - DNA, 20 bp, synthetic construct
  source 1..20: mol_type = other DNA
aaacctatgaatgcctctgt

SEQ ID NO: 1443 - DNA, 20 bp, synthetic construct
  source 1..20: mol_type = other DNA
caccattgtgaagatatgac

SEQ ID NO: 1444 - DNA, 20 bp, synthetic construct
  source 1..20: mol_type = other DNA
gctatttttgaataagcagg

SEQ ID NO: 1445 - DNA, 20 bp, synthetic construct
  source 1..20: mol_type = other DNA
tcaagaccttcaaatcacct

SEQ ID NO: 1446 - DNA, 20 bp, synthetic construct
  source 1..20: mol_type = other DNA
tgactggtgcattctgttat

SEQ ID NO: 1447 - DNA, 20 bp, synthetic construct
  source 1..20: mol_type = other DNA
aataacctttatgttaaacc

SEQ ID NO: 1448 - DNA, 20 bp, synthetic construct
  source 1..20: mol_type = other DNA
gaagtgaacaatatttgggc

SEQ ID NO: 1449 - DNA, 20 bp, synthetic construct
  source 1..20: mol_type = other DNA
actttatacaaagtcagcaa

SEQ ID NO: 1450 - DNA, 20 bp, synthetic construct
  source 1..20: mol_type = other DNA
gctttcagcatgtgagattg

SEQ ID NO: 1451 - DNA, 20 bp, synthetic construct
  source 1..20: mol_type = other DNA
gcctccattcctttgtgact

SEQ ID NO: 1452 - DNA, 20 bp, synthetic construct
  source 1..20: mol_type = other DNA
aaaacaagtatcaagtgtct

SEQ ID NO: 1453 - DNA, 20 bp, synthetic construct
  source 1..20: mol_type = other DNA
tcctcaggccagtctgttct

SEQ ID NO: 1454 - DNA, 20 bp, synthetic construct
  source 1..20: mol_type = other DNA
tctttaatttcctgaggaag

SEQ ID NO: 1455 - DNA, 20 bp, synthetic construct
  source 1..20: mol_type = other DNA
tcctttttcctggaagctta

SEQ ID NO: 1456 - DNA, 20 bp, synthetic construct
  source 1..20: mol_type = other DNA
taacacaccaagataacatt

SEQ ID NO: 1457 - DNA, 20 bp, synthetic construct
  source 1..20: mol_type = other DNA
gattacttcactgtccttta

SEQ ID NO: 1458 - DNA, 20 bp, synthetic construct
  source 1..20: mol_type = other DNA
tgttatgttattaaatcaaa

SEQ ID NO: 1459 - DNA, 20 bp, synthetic construct
  source 1..20: mol_type = other DNA
gttatgttattaaatcaaaa

SEQ ID NO: 1460 - DNA, 20 bp, synthetic construct
  source 1..20: mol_type = other DNA
tacaaagtcagcaaagcatg

SEQ ID NO: 1461 - DNA, 20 bp, synthetic construct
  source 1..20: mol_type = other DNA
ttgaagtaaatgtacacagg

SEQ ID NO: 1462 - DNA, 20 bp, synthetic construct
  source 1..20: mol_type = other DNA
aattcaccaaatctgtttct

SEQ ID NO: 1463 - DNA, 20 bp, synthetic construct
  source 1..20: mol_type = other DNA
cttaatgtccaattttccta

SEQ ID NO: 1464 - DNA, 20 bp, synthetic construct
  source 1..20: mol_type = other DNA
gcattaacaggtagacaaac

SEQ ID NO: 1465 - DNA, 20 bp, synthetic construct
  source 1..20: mol_type = other DNA
atctcaggttacaccattag

SEQ ID NO: 1466 - DNA, 20 bp, synthetic construct
  source 1..20: mol_type = other DNA
ctttgtaagataagtttcta

SEQ ID NO: 1467 - DNA, 20 bp, synthetic construct
  source 1..20: mol_type = other DNA
gctacatttgatagggaata

SEQ ID NO: 1468 - DNA, 20 bp, synthetic construct
  source 1..20: mol_type = other DNA
aaatcattttccattagcta

SEQ ID NO: 1469 - DNA, 20 bp, synthetic construct
  source 1..20: mol_type = other DNA
aacttctaaagttccttcca

SEQ ID NO: 1470 - DNA, 20 bp, synthetic construct
  source 1..20: mol_type = other DNA
ccagggttgaggttgttatt

SEQ ID NO: 1471 - DNA, 20 bp, synthetic construct
  source 1..20: mol_type = other DNA
aattaaaaccaatcagactt

SEQ ID NO: 1472 - DNA, 20 bp, synthetic construct
  source 1..20: mol_type = other DNA
gtgccaaaacacgactcatt

SEQ ID NO: 1473 - DNA, 20 bp, synthetic construct
  source 1..20: mol_type = other DNA
ccaactttaagcccttctca

SEQ ID NO: 1474 - DNA, 20 bp, synthetic construct
  source 1..20: mol_type = other DNA
gaatggataataccccatga

SEQ ID NO: 1475 - DNA, 20 bp, synthetic construct
  source 1..20: mol_type = other DNA
aacacaccaagataacattg

SEQ ID NO: 1476 - DNA, 20 bp, synthetic construct
  source 1..20: mol_type = other DNA
gctcttattgtttttctgac

SEQ ID NO: 1477 - DNA, 20 bp, synthetic construct
  source 1..20: mol_type = other DNA
gttacactcatcaagtaaga

SEQ ID NO: 1478 - DNA, 20 bp, synthetic construct
  source 1..20: mol_type = other DNA
cgatcagattactcaaattg

SEQ ID NO: 1479 - DNA, 20 bp, synthetic construct
  source 1..20: mol_type = other DNA
tagacctaatattttcaact

SEQ ID NO: 1480 - DNA, 20 bp, synthetic construct
  source 1..20: mol_type = other DNA
tgttaaaattgcaattctat

SEQ ID NO: 1481 - DNA, 20 bp, synthetic construct
  source 1..20: mol_type = other DNA
gcatgtgagattgacccaga

SEQ ID NO: 1482 - DNA, 20 bp, synthetic construct
  source 1..20: mol_type = other DNA
accaacagatggcttagaaa

SEQ ID NO: 1483 - DNA, 20 bp, synthetic construct
  source 1..20: mol_type = other DNA
ccgtaatttatgactgcaaa

SEQ ID NO: 1484 - DNA, 20 bp, synthetic construct
  source 1..20: mol_type = other DNA
cattccagaaattgatcttc

SEQ ID NO: 1485 - DNA, 20 bp, synthetic construct
  source 1..20: mol_type = other DNA
aaacaagtatcaagtgtctt

SEQ ID NO: 1486 - DNA, 20 bp, synthetic construct
  source 1..20: mol_type = other DNA
attctcacatttccagtcta

SEQ ID NO: 1487 - DNA, 20 bp, synthetic construct
  source 1..20: mol_type = other DNA
acagtcataatcaaagaatt

SEQ ID NO: 1488 - DNA, 20 bp, synthetic construct
  source 1..20: mol_type = other DNA
caaagagagaccttaatcac

SEQ ID NO: 1489 - DNA, 20 bp, synthetic construct
  source 1..20: mol_type = other DNA
atacttgtagaaaatcccaa

SEQ ID NO: 1490 - DNA, 20 bp, synthetic construct
  source 1..20: mol_type = other DNA
aatatatttggcccctatag

SEQ ID NO: 1491 - DNA, 20 bp, synthetic construct
  source 1..20: mol_type = other DNA
cagtggaagtaccctttgag

SEQ ID NO: 1492 - DNA, 20 bp, synthetic construct
  source 1..20: mol_type = other DNA
tgaagcaaaatgactaaaag

SEQ ID NO: 1493 - DNA, 20 bp, synthetic construct
  source 1..20: mol_type = other DNA
ttcaactagccaatttttaa

SEQ ID NO: 1494 - DNA, 20 bp, synthetic construct
  source 1..20: mol_type = other DNA
ataacctttatgttaaacct

SEQ ID NO: 1495 - DNA, 20 bp, synthetic construct
  source 1..20: mol_type = other DNA
gaaagatccttgctttgacc

SEQ ID NO: 1496 - DNA, 20 bp, synthetic construct
  source 1..20: mol_type = other DNA
tttttcctggaagcttacca

SEQ ID NO: 1497 - DNA, 20 bp, synthetic construct
  source 1..20: mol_type = other DNA
ttcccatttctagcaggaac

SEQ ID NO: 1498 - DNA, 20 bp, synthetic construct
  source 1..20: mol_type = other DNA
tggtggcaaaggcaaagagt

SEQ ID NO: 1499 - DNA, 20 bp, synthetic construct
  source 1..20: mol_type = other DNA
cctccattcctttgtgactt

SEQ ID NO: 1500 - DNA, 20 bp, synthetic construct
  source 1..20: mol_type = other DNA
gtgaacaatatttgggcttt

SEQ ID NO: 1501 - DNA, 20 bp, synthetic construct
  source 1..20: mol_type = other DNA
atattgctgaaaccactttg

SEQ ID NO: 1502 - DNA, 20 bp, synthetic construct
  source 1..20: mol_type = other DNA
tgcagcctggaagcttatct

SEQ ID NO: 1503 - DNA, 20 bp, synthetic construct
  source 1..20: mol_type = other DNA
aatgaaggaaacactttcag

SEQ ID NO: 1504 - DNA, 20 bp, synthetic construct
  source 1..20: mol_type = other DNA
acttcactgtcctttatctt

SEQ ID NO: 1505 - DNA, 20 bp, synthetic construct
  source 1..20: mol_type = other DNA
tgctatccaaagagttatct

SEQ ID NO: 1506 - DNA, 20 bp, synthetic construct
  source 1..20: mol_type = other DNA
gaaaccacagggttgtcatg

SEQ ID NO: 1507 - DNA, 20 bp, synthetic construct
  source 1..20: mol_type = other DNA
taagtaaggttggctgagtt

SEQ ID NO: 1508 - DNA, 20 bp, synthetic construct
  source 1..20: mol_type = other DNA
tgcacaatgagcacactaca

SEQ ID NO: 1509 - DNA, 20 bp, synthetic construct
  source 1..20: mol_type = other DNA
cccaaataacccactcacct

SEQ ID NO: 1510 - DNA, 20 bp, synthetic construct
  source 1..20: mol_type = other DNA
attctgttatgtgatctata

SEQ ID NO: 1511 - DNA, 20 bp, synthetic construct
  source 1..20: mol_type = other DNA
ctttcagaatagctgtaccc

SEQ ID NO: 1512 - DNA, 20 bp, synthetic construct
  source 1..20: mol_type = other DNA
tataccacattcaagtgctg

SEQ ID NO: 1513 - DNA, 20 bp, synthetic construct
  source 1..20: mol_type = other DNA
taacgaggtgtaaggccaga

SEQ ID NO: 1514 - DNA, 20 bp, synthetic construct
  source 1..20: mol_type = other DNA
agagtacacaactaattaac

SEQ ID NO: 1515 - DNA, 20 bp, synthetic construct
  source 1..20: mol_type = other DNA
caaaagaactgtagtacaaa

SEQ ID NO: 1516 - DNA, 20 bp, synthetic construct
  source 1..20: mol_type = other DNA
accttgttcctcaggtcagt

SEQ ID NO: 1517 - DNA, 20 bp, synthetic construct
  source 1..20: mol_type = other DNA
cctatgaatgcctctgtgca

SEQ ID NO: 1518 - DNA, 20 bp, synthetic construct
  source 1..20: mol_type = other DNA
acggcaaagttgtaagtggc

SEQ ID NO: 1519 - DNA, 20 bp, synthetic construct
  source 1..20: mol_type = other DNA
ggtaacagccactgttctca

SEQ ID NO: 1520 - DNA, 20 bp, synthetic construct
  source 1..20: mol_type = other DNA
aagggagtgagaagatgctg

SEQ ID NO: 1521 - DNA, 20 bp, synthetic construct
  source 1..20: mol_type = other DNA
gaaaagactgaaatctggga

SEQ ID NO: 1522 - DNA, 20 bp, synthetic construct
  source 1..20: mol_type = other DNA
tttacagttgttatagatct

SEQ ID NO: 1523 - DNA, 20 bp, synthetic construct
  source 1..20: mol_type = other DNA
ccaaagacattccttctctg

SEQ ID NO: 1524 - DNA, 20 bp, synthetic construct
  source 1..20: mol_type = other DNA
ctatttttgaataagcaggt

SEQ ID NO: 1525 - DNA, 20 bp, synthetic construct
  source 1..20: mol_type = other DNA
accattgtgaagatatgaca

SEQ ID NO: 1526 - DNA, 20 bp, synthetic construct
  source 1..20: mol_type = other DNA
ggacccaatgtgcatcctca

SEQ ID NO: 1527 - DNA, 20 bp, synthetic construct
  source 1..20: mol_type = other DNA
tgaaatgtgcatcattctaa

SEQ ID NO: 1528 - DNA, 20 bp, synthetic construct
  source 1..20: mol_type = other DNA
ttttacatccatttttcctc

SEQ ID NO: 1529 - DNA, 20 bp, synthetic construct
  source 1..20: mol_type = other DNA
caggccagtctgttctcatg

SEQ ID NO: 1530 - DNA, 20 bp, synthetic construct
  source 1..20: mol_type = other DNA
atcctcaggagatgcttgaa

SEQ ID NO: 1531 - DNA, 20 bp, synthetic construct
  source 1..20: mol_type = other DNA
ctgatgcaaccccaaataag

SEQ ID NO: 1532 - DNA, 20 bp, synthetic construct
  source 1..20: mol_type = other DNA
tagagagaccagaatgaatt

SEQ ID NO: 1533 - DNA, 20 bp, synthetic construct
  source 1..20: mol_type = other DNA
gcagaagtgaagaatctcag

SEQ ID NO: 1534 - DNA, 20 bp, synthetic construct
  source 1..20: mol_type = other DNA
caagaccttcaaatcaccta

SEQ ID NO: 1535 - DNA, 20 bp, synthetic construct
  source 1..20: mol_type = other DNA
tcctcaggtcagtctcccac

SEQ ID NO: 1536 - DNA, 20 bp, synthetic construct
  source 1..20: mol_type = other DNA
gtggaagtaccctttgagaa

SEQ ID NO: 1537 - DNA, 20 bp, synthetic construct
  source 1..20: mol_type = other DNA
aatggataataccccatgaa

SEQ ID NO: 1538 - DNA, 20 bp, synthetic construct
  source 1..20: mol_type = other DNA
cagtctgttctcatgtaagc

SEQ ID NO: 1539 - DNA, 20 bp, synthetic construct
  source 1..20: mol_type = other DNA
aagaccttcaaatcacctac

SEQ ID NO: 1540 - DNA, 20 bp, synthetic construct
  source 1..20: mol_type = other DNA
acttctaaagttccttccaa

SEQ ID NO: 1541 - DNA, 20 bp, synthetic construct
  source 1..20: mol_type = other DNA
ggttgttattactcagatcg

SEQ ID NO: 1542 - DNA, 20 bp, synthetic construct
  source 1..20: mol_type = other DNA
gcattgtaggctgtgtggtt

SEQ ID NO: 1543 - DNA, 20 bp, synthetic construct
  source 1..20: mol_type = other DNA
ccattcctttgtgacttgca

SEQ ID NO: 1544 - DNA, 20 bp, synthetic construct
  source 1..20: mol_type = other DNA
tctcaggttacaccattagc

SEQ ID NO: 1545 - DNA, 20 bp, synthetic construct
  source 1..20: mol_type = other DNA
ccattgtgaagatatgacag

SEQ ID NO: 1546 - DNA, 20 bp, synthetic construct
  source 1..20: mol_type = other DNA
cactgtcctttatcttgatt

SEQ ID NO: 1547 - DNA, 20 bp, synthetic construct
  source 1..20: mol_type = other DNA
tttgtaagataagtttctaa

SEQ ID NO: 1548 - DNA, 20 bp, synthetic construct
  source 1..20: mol_type = other DNA
acgaggtgtaaggccagatg

SEQ ID NO: 1549 - DNA, 20 bp, synthetic construct
  source 1..20: mol_type = other DNA
ggtggcaaaggcaaagagtt

SEQ ID NO: 1550 - DNA, 20 bp, synthetic construct
  source 1..20: mol_type = other DNA
aaaagactgaaatctgggag

SEQ ID NO: 1551 - DNA, 20 bp, synthetic construct
  source 1..20: mol_type = other DNA
tcctcaggagatgcttgaaa

SEQ ID NO: 1552 - DNA, 20 bp, synthetic construct
  source 1..20: mol_type = other DNA
tgaagtaaatgtacacaggc

SEQ ID NO: 1553 - DNA, 20 bp, synthetic construct
  source 1..20: mol_type = other DNA
accacattcaagtgctggaa

SEQ ID NO: 1554 - DNA, 20 bp, synthetic construct
  source 1..20: mol_type = other DNA
gctatccaaagagttatcta

SEQ ID NO: 1555 - DNA, 20 bp, synthetic construct
  source 1..20: mol_type = other DNA
tacactcatcaagtaagaag

SEQ ID NO: 1556 - DNA, 20 bp, synthetic construct
  source 1..20: mol_type = other DNA
ggcaaagttgtaagtggcag

SEQ ID NO: 1557 - DNA, 20 bp, synthetic construct
  source 1..20: mol_type = other DNA
gagtacacaactaattaaca

SEQ ID NO: 1558 - DNA, 20 bp, synthetic construct
  source 1..20: mol_type = other DNA
taacctttatgttaaaccta

SEQ ID NO: 1559 - DNA, 20 bp, synthetic construct
  source 1..20: mol_type = other DNA
taacccactcacctcagctg

SEQ ID NO: 1560 - DNA, 20 bp, synthetic construct
  source 1..20: mol_type = other DNA
ttcagaatagctgtacccac

SEQ ID NO: 1561 - DNA, 20 bp, synthetic construct
  source 1..20: mol_type = other DNA
tcaacagaaccaatgtgact

SEQ ID NO: 1562 - DNA, 20 bp, synthetic construct
  source 1..20: mol_type = other DNA
tgttatagatcttgcccatt

SEQ ID NO: 1563 - DNA, 20 bp, synthetic construct
  source 1..20: mol_type = other DNA
tcaactagccaatttttaat

SEQ ID NO: 1564 - DNA, 20 bp, synthetic construct
  source 1..20: mol_type = other DNA
aatctcagtcagtctgtcca

SEQ ID NO: 1565 - DNA, 20 bp, synthetic construct
  source 1..20: mol_type = other DNA
aaaccacagggttgtcatgg

SEQ ID NO: 1566 - DNA, 20 bp, synthetic construct
  source 1..20: mol_type = other DNA
ttatgttattaaatcaaaac

SEQ ID NO: 1567 - DNA, 20 bp, synthetic construct
  source 1..20: mol_type = other DNA
attgctgaaaccactttggg

SEQ ID NO: 1568 - DNA, 20 bp, synthetic construct
  source 1..20: mol_type = other DNA
gcagcctggaagcttatctt

SEQ ID NO: 1569 - DNA, 20 bp, synthetic construct
  source 1..20: mol_type = other DNA
aagtaaggttggctgagtta

SEQ ID NO: 1570 - DNA, 20 bp, synthetic construct
  source 1..20: mol_type = other DNA
agggagtgagaagatgctga

SEQ ID NO: 1571 - DNA, 20 bp, synthetic construct
  source 1..20: mol_type = other DNA
ttttcctggaagcttaccaa

SEQ ID NO: 1572 - DNA, 20 bp, synthetic construct
  source 1..20: mol_type = other DNA
acatccatttttcctctatt

SEQ ID NO: 1573 - DNA, 20 bp, synthetic construct
  source 1..20: mol_type = other DNA
tgaacaatatttgggctttg

SEQ ID NO: 1574 - DNA, 20 bp, synthetic construct
  source 1..20: mol_type = other DNA
acacaccaagataacattgc

SEQ ID NO: 1575 - DNA, 20 bp, synthetic construct
  source 1..20: mol_type = other DNA
gaagcaaaatgactaaaaga

SEQ ID NO: 1576 - DNA, 20 bp, synthetic construct
  source 1..20: mol_type = other DNA
tcacatttccagtctaagta

SEQ ID NO: 1577 - DNA, 20 bp, synthetic construct
  source 1..20: mol_type = other DNA
caaagacattccttctctgt

SEQ ID NO: 1578 - DNA, 20 bp, synthetic construct
  source 1..20: mol_type = other DNA
ttaatgtccaattttcctag

SEQ ID NO: 1579 - DNA, 20 bp, synthetic construct
  source 1..20: mol_type = other DNA
acacgactcatttaaaccat

SEQ ID NO: 1580 - DNA, 20 bp, synthetic construct
  source 1..20: mol_type = other DNA
tcctcagggatttcatcccc

SEQ ID NO: 1581 - DNA, 20 bp, synthetic construct
  source 1..20: mol_type = other DNA
atatatttggcccctataga

SEQ ID NO: 1582 - DNA, 20 bp, synthetic construct
  source 1..20: mol_type = other DNA
attaaaaccaatcagacttt

SEQ ID NO: 1583 - DNA, 20 bp, synthetic construct
  source 1..20: mol_type = other DNA
aaaagaactgtagtacaaat

SEQ ID NO: 1584 - DNA, 20 bp, synthetic construct
  source 1..20: mol_type = other DNA
gatcagattactcaaattga

SEQ ID NO: 1585 - DNA, 20 bp, synthetic construct
  source 1..20: mol_type = other DNA
gaaatgtgcatcattctaaa

SEQ ID NO: 1586 - DNA, 20 bp, synthetic construct
  source 1..20: mol_type = other DNA
tgtgagattgacccagaatc

SEQ ID NO: 1587 - DNA, 20 bp, synthetic construct
  source 1..20: mol_type = other DNA
gcacaatgagcacactacat

SEQ ID NO: 1588 - DNA, 20 bp, synthetic construct
  source 1..20: mol_type = other DNA
gcatgaaacatctttctggc

SEQ ID NO: 1589 - DNA, 20 bp, synthetic construct
  source 1..20: mol_type = other DNA
tgttatgtgatctatatcag

SEQ ID NO: 1590 - DNA, 20 bp, synthetic construct
  source 1..20: mol_type = other DNA
ctatgaatgcctctgtgcac

SEQ ID NO: 1591 - DNA, 20 bp, synthetic construct
  source 1..20: mol_type = other DNA
atgaaggaaacactttcagt

SEQ ID NO: 1592 - DNA, 20 bp, synthetic construct
  source 1..20: mol_type = other DNA
acataagtgaggtatacacc

SEQ ID NO: 1593 - DNA, 20 bp, synthetic construct
  source 1..20: mol_type = other DNA
cccatttctagcaggaacca

SEQ ID NO: 1594 - DNA, 20 bp, synthetic construct
  source 1..20: mol_type = other DNA
attccagaaattgatcttcc

SEQ ID NO: 1595 - DNA, 20 bp, synthetic construct
  source 1..20: mol_type = other DNA
aaagagagaccttaatcact

SEQ ID NO: 1596 - DNA, 20 bp, synthetic construct
  source 1..20: mol_type = other DNA
cgtaatttatgactgcaaag

SEQ ID NO: 1597 - DNA, 20 bp, synthetic construct
  source 1..20: mol_type = other DNA
aacaagtatcaagtgtcttt

SEQ ID NO: 1598 - DNA, 20 bp, synthetic construct
  source 1..20: mol_type = other DNA
cagtcataatcaaagaatta

SEQ ID NO: 1599 - DNA, 20 bp, synthetic construct
  source 1..20: mol_type = other DNA
gtaacagccactgttctcag

SEQ ID NO: 1600 - DNA, 20 bp, synthetic construct
  source 1..20: mol_type = other DNA
atcattttccattagctaga

SEQ ID NO: 1601 - DNA, 20 bp, synthetic construct
  source 1..20: mol_type = other DNA
agagagaccagaatgaattc

SEQ ID NO: 1602 - DNA, 20 bp, synthetic construct
  source 1..20: mol_type = other DNA
ttgtacaaagcatcccacaa

SEQ ID NO: 1603 - DNA, 20 bp, synthetic construct
  source 1..20: mol_type = other DNA
agatccttgctttgaccccc

SEQ ID NO: 1604 - DNA, 20 bp, synthetic construct
  source 1..20: mol_type = other DNA
caactgagtctcatttcatt

SEQ ID NO: 1605 - DNA, 20 bp, synthetic construct
  source 1..20: mol_type = other DNA
tcttattgtttttctgacat

SEQ ID NO: 1606 - DNA, 20 bp, synthetic construct
  source 1..20: mol_type = other DNA
gttaaaattgcaattctata

SEQ ID NO: 1607 - DNA, 20 bp, synthetic construct
  source 1..20: mol_type = other DNA
tacttgtagaaaatcccaat

SEQ ID NO: 1608 - DNA, 20 bp, synthetic construct
  source 1..20: mol_type = other DNA
tgatgcaaccccaaataagt

SEQ ID NO: 1609 - DNA, 20 bp, synthetic construct
  source 1..20: mol_type = other DNA
tgaataagcaggttgtgaca

SEQ ID NO: 1610 - DNA, 20 bp, synthetic construct
  source 1..20: mol_type = other DNA
attcaccaaatctgtttctg

SEQ ID NO: 1611 - DNA, 20 bp, synthetic construct
  source 1..20: mol_type = other DNA
agacctaatattttcaacta

SEQ ID NO: 1612 - DNA, 20 bp, synthetic construct
  source 1..20: mol_type = other DNA
cccaaagttggaaattctct

SEQ ID NO: 1613 - DNA, 20 bp, synthetic construct
  source 1..20: mol_type = other DNA
ttattgtttttctgacattc

SEQ ID NO: 1614 - DNA, 20 bp, synthetic construct
  source 1..20: mol_type = other DNA
atggataataccccatgaaa

SEQ ID NO: 1615 - DNA, 20 bp, synthetic construct
  source 1..20: mol_type = other DNA
tggaagtaccctttgagaag

SEQ ID NO: 1616 - DNA, 20 bp, synthetic construct
  source 1..20: mol_type = other DNA
tctgttctcatgtaagctag

SEQ ID NO: 1617 - DNA, 20 bp, synthetic construct
  source 1..20: mol_type = other DNA
gtcataatcaaagaattatt

SEQ ID NO: 1618 - DNA, 20 bp, synthetic construct
  source 1..20: mol_type = other DNA
gaagtaaatgtacacaggca

SEQ ID NO: 1619 - DNA, 20 bp, synthetic construct
  source 1..20: mol_type = other DNA
tatgttattaaatcaaaaca

SEQ ID NO: 1620 - DNA, 20 bp, synthetic construct
  source 1..20: mol_type = other DNA
aagagagaccttaatcactg

SEQ ID NO: 1621 - DNA, 20 bp, synthetic construct
  source 1..20: mol_type = other DNA
acctaatattttcaactaac

SEQ ID NO: 1622 - DNA, 20 bp, synthetic construct
  source 1..20: mol_type = other DNA
aaccacagggttgtcatggt

SEQ ID NO: 1623 - DNA, 20 bp, synthetic construct
  source 1..20: mol_type = other DNA
ccatttctagcaggaaccag

SEQ ID NO: 1624 - DNA, 20 bp, synthetic construct
  source 1..20: mol_type = other DNA
cacactacattcacagggca

SEQ ID NO: 1625 - DNA, 20 bp, synthetic construct
  source 1..20: mol_type = other DNA
aacctttatgttaaacctaa

SEQ ID NO: 1626 - DNA, 20 bp, synthetic construct
  source 1..20: mol_type = other DNA
caactagccaatttttaata

SEQ ID NO: 1627 - DNA, 20 bp, synthetic construct
  source 1..20: mol_type = other DNA
agaccttcaaatcacctacg

SEQ ID NO: 1628 - DNA, 20 bp, synthetic construct
  source 1..20: mol_type = other DNA
ccttgctttgacccccttct

SEQ ID NO: 1629 - DNA, 20 bp, synthetic construct
  source 1..20: mol_type = other DNA
aaagactgaaatctgggagc

SEQ ID NO: 1630 - DNA, 20 bp, synthetic construct
  source 1..20: mol_type = other DNA
cctcagggatttcatcccct

SEQ ID NO: 1631 - DNA, 20 bp, synthetic construct
  source 1..20: mol_type = other DNA
gcaaagttgtaagtggcagc

SEQ ID NO: 1632 - DNA, 20 bp, synthetic construct
  source 1..20: mol_type = other DNA
acttgtagaaaatcccaata

SEQ ID NO: 1633 - DNA, 20 bp, synthetic construct
  source 1..20: mol_type = other DNA
ttaaaattgcaattctatat

SEQ ID NO: 1634 - DNA, 20 bp, synthetic construct
  source 1..20: mol_type = other DNA
aacccactcacctcagctgt

SEQ ID NO: 1635 - DNA, 20 bp, synthetic construct
  source 1..20: mol_type = other DNA
atttacttgccaagatcatt

SEQ ID NO: 1636 - DNA, 20 bp, synthetic construct
  source 1..20: mol_type = other DNA
cacagcccattttcttgata

SEQ ID NO: 1637 - DNA, 20 bp, synthetic construct
  source 1..20: mol_type = other DNA
ttgtaagataagtttctaaa

SEQ ID NO: 1638 - DNA, 20 bp, synthetic construct
  source 1..20: mol_type = other DNA
acaatatttgggctttgcca

SEQ ID NO: 1639 - DNA, 20 bp, synthetic construct
  source 1..20: mol_type = other DNA
caggtcagtctcccaccatt

SEQ ID NO: 1640 - DNA, 20 bp, synthetic construct
  source 1..20: mol_type = other DNA
gcatcccacaaaactcatgc

SEQ ID NO: 1641 - DNA, 20 bp, synthetic construct
  source 1..20: mol_type = other DNA
ttattgttacttgattctca

SEQ ID NO: 1642 - DNA, 20 bp, synthetic construct
  source 1..20: mol_type = other DNA
ctatccaaagagttatctat

SEQ ID NO: 1643 - DNA, 20 bp, synthetic construct
  source 1..20: mol_type = other DNA
aatgtgcatcattctaaaac

SEQ ID NO: 1644 - DNA, 20 bp, synthetic construct
  source 1..20: mol_type = other DNA
acagccactgttctcagacg

SEQ ID NO: 1645 - DNA, 20 bp, synthetic construct
  source 1..20: mol_type = other DNA
cattgtaggctgtgtggtta

SEQ ID NO: 1646 - DNA, 20 bp, synthetic construct
  source 1..20: mol_type = other DNA
gttatgtgatctatatcagg

SEQ ID NO: 1647 - DNA, 20 bp, synthetic construct
  source 1..20: mol_type = other DNA
tgaaggaaacactttcagtt

SEQ ID NO: 1648 - DNA, 20 bp, synthetic construct
  source 1..20: mol_type = other DNA
agaaccaatgtgacttacac

SEQ ID NO: 1649 - DNA, 20 bp, synthetic construct
  source 1..20: mol_type = other DNA
ggagtgagaagatgctgaca

SEQ ID NO: 1650 - DNA, 20 bp, synthetic construct
  source 1..20: mol_type = other DNA
tgactgcaaagtacttggca

SEQ ID NO: 1651 - DNA, 20 bp, synthetic construct
  source 1..20: mol_type = other DNA
acaagtatcaagtgtctttt

SEQ ID NO: 1652 - DNA, 20 bp, synthetic construct
  source 1..20: mol_type = other DNA
tttcctggaagcttaccaac

SEQ ID NO: 1653 - DNA, 20 bp, synthetic construct
  source 1..20: mol_type = other DNA
gaataagcaggttgtgacag

SEQ ID NO: 1654 - DNA, 20 bp, synthetic construct
  source 1..20: mol_type = other DNA
cattcctttgtgacttgcag

SEQ ID NO: 1655 - DNA, 20 bp, synthetic construct
  source 1..20: mol_type = other DNA
atgaaacatctttctggcac

SEQ ID NO: 1656 - DNA, 20 bp, synthetic construct
  source 1..20: mol_type = other DNA
gggaaaagaacaacacaact

SEQ ID NO: 1657 - DNA, 20 bp, synthetic construct
  source 1..20: mol_type = other DNA
tttatcttgattggtttctt

SEQ ID NO: 1658 - DNA, 20 bp, synthetic construct
  source 1..20: mol_type = other DNA
cacaccaagataacattgct

SEQ ID NO: 1659 - DNA, 20 bp, synthetic construct
  source 1..20: mol_type = other DNA
aagcaaaatgactaaaagag

SEQ ID NO: 1660 - DNA, 20 bp, synthetic construct
  source 1..20: mol_type = other DNA
aagaactgtagtacaaatct

SEQ ID NO: 1661 - DNA, 20 bp, synthetic construct
  source 1..20: mol_type = other DNA
gcctggaagcttatcttgta

SEQ ID NO: 1662 - DNA, 20 bp, synthetic construct
  source 1..20: mol_type = other DNA
tgtgtttaagctgctatctt

SEQ ID NO: 1663 - DNA, 20 bp, synthetic construct
  source 1..20: mol_type = other DNA
ttcaccaaatctgtttctgc

SEQ ID NO: 1664 - DNA, 20 bp, synthetic construct
  source 1..20: mol_type = other DNA
taatgtccaattttcctagt

SEQ ID NO: 1665 - DNA, 20 bp, synthetic construct
  source 1..20: mol_type = other DNA
ccatttttcctctattttct

SEQ ID NO: 1666 - DNA, 20 bp, synthetic construct
  source 1..20: mol_type = other DNA
acactcatcaagtaagaaga

SEQ ID NO: 1667 - DNA, 20 bp, synthetic construct
  source 1..20: mol_type = other DNA
cctcaggagatgcttgaaaa

SEQ ID NO: 1668 - DNA, 20 bp, synthetic construct
  source 1..20: mol_type = other DNA
agtacacaactaattaacag

SEQ ID NO: 1669 - DNA, 20 bp, synthetic construct
  source 1..20: mol_type = other DNA
tcagtcagtctgtccaagca

SEQ ID NO: 1670 - DNA, 20 bp, synthetic construct
  source 1..20: mol_type = other DNA
cattttccattagctagaaa

SEQ ID NO: 1671 - DNA, 20 bp, synthetic construct
  source 1..20: mol_type = other DNA
atcagattactcaaattgag

SEQ ID NO: 1672 - DNA, 20 bp, synthetic construct
  source 1..20: mol_type = other DNA
cgaggtgtaaggccagatgc

SEQ ID NO: 1673 - DNA, 20 bp, synthetic construct
  source 1..20: mol_type = other DNA
aaagacattccttctctgta

SEQ ID NO: 1674 - DNA, 20 bp, synthetic construct
  source 1..20: mol_type = other DNA
ttccagaaattgatcttcct

SEQ ID NO: 1675 - DNA, 20 bp, synthetic construct
  source 1..20: mol_type = other DNA
tctaaagttccttccaatcc

SEQ ID NO: 1676 - DNA, 20 bp, synthetic construct
  source 1..20: mol_type = other DNA
atatttggcccctatagatg

SEQ ID NO: 1677 - DNA, 20 bp, synthetic construct
  source 1..20: mol_type = other DNA
gtggcaaaggcaaagagtta

SEQ ID NO: 1678 - DNA, 20 bp, synthetic construct
  source 1..20: mol_type = other DNA
gagattgacccagaatcctt

SEQ ID NO: 1679 - DNA, 20 bp, synthetic construct
  source 1..20: mol_type = other DNA
ttaaaaccaatcagactttt

SEQ ID NO: 1680 - DNA, 20 bp, synthetic construct
  source 1..20: mol_type = other DNA
cataagtgaggtatacacca

SEQ ID NO: 1681 - DNA, 20 bp, synthetic construct
  source 1..20: mol_type = other DNA
ttgttattactcagatcgct

SEQ ID NO: 1682 - DNA, 20 bp, synthetic construct
  source 1..20: mol_type = other DNA
acatttccagtctaagtaca

SEQ ID NO: 1683 - DNA, 20 bp, synthetic construct
  source 1..20: mol_type = other DNA
cattgtgaagatatgacaga

SEQ ID NO: 1684 - DNA, 20 bp, synthetic construct
  source 1..20: mol_type = other DNA
gagagaccagaatgaattcc

SEQ ID NO: 1685 - DNA, 20 bp, synthetic construct
  source 1..20: mol_type = other DNA
ccacattcaagtgctggaaa

SEQ ID NO: 1686 - DNA, 20 bp, synthetic construct
  source 1..20: mol_type = other DNA
gatgcaaccccaaataagta

SEQ ID NO: 1687 - DNA, 20 bp, synthetic construct
  source 1..20: mol_type = other DNA
gtaaggttggctgagttagg

SEQ ID NO: 1688 - DNA, 20 bp, synthetic construct
  source 1..20: mol_type = other DNA
acactacattcacagggcac

SEQ ID NO: 1689 - DNA, 20 bp, synthetic construct
  source 1..20: mol_type = other DNA
ttgtattaattacttaggct

SEQ ID NO: 1690 - DNA, 20 bp, synthetic construct
  source 1..20: mol_type = other DNA
agattgacccagaatcctta

SEQ ID NO: 1691 - DNA, 20 bp, synthetic construct
  source 1..20: mol_type = other DNA
gccactgttctcagacgaca

SEQ ID NO: 1692 - DNA, 20 bp, synthetic construct
  source 1..20: mol_type = other DNA
ggatagtcaaatcatgtgga

SEQ ID NO: 1693 - DNA, 20 bp, synthetic construct
  source 1..20: mol_type = other DNA
ttatgtgatctatatcagga

SEQ ID NO: 1694 - DNA, 20 bp, synthetic construct
  source 1..20: mol_type = other DNA
aagactgaaatctgggagct

SEQ ID NO: 1695 - DNA, 20 bp, synthetic construct
  source 1..20: mol_type = other DNA
tgtaagataagtttctaaaa

SEQ ID NO: 1696 - DNA, 20 bp, synthetic construct
  source 1..20: mol_type = other DNA
ctaaagttccttccaatccc

SEQ ID NO: 1697 - DNA, 20 bp, synthetic construct
  source 1..20: mol_type = other DNA
gtacacaactaattaacaga

SEQ ID NO: 1698 - DNA, 20 bp, synthetic construct
  source 1..20: mol_type = other DNA
ctcaggagatgcttgaaaat

SEQ ID NO: 1699 - DNA, 20 bp, synthetic construct
  source 1..20: mol_type = other DNA
gaaggaaacactttcagttg

SEQ ID NO: 1700 - DNA, 20 bp, synthetic construct
  source 1..20: mol_type = other DNA
attgtgaagatatgacagag

SEQ ID NO: 1701 - DNA, 20 bp, synthetic construct
  source 1..20: mol_type = other DNA
gaggtgtaaggccagatgcc

SEQ ID NO: 1702 - DNA, 20 bp, synthetic construct
  source 1..20: mol_type = other DNA
tcaccaaatctgtttctgca

SEQ ID NO: 1703 - DNA, 20 bp, synthetic construct
  source 1..20: mol_type = other DNA
aagtatcaagtgtctttttg

SEQ ID NO: 1704 - DNA, 20 bp, synthetic construct
  source 1..20: mol_type = other DNA
agaactgtagtacaaatctt

SEQ ID NO: 1705 - DNA, 20 bp, synthetic construct
  source 1..20: mol_type = other DNA
caggttacaccattagccac

SEQ ID NO: 1706 - DNA, 20 bp, synthetic construct
  source 1..20: mol_type = other DNA
tcagattactcaaattgaga

SEQ ID NO: 1707 - DNA, 20 bp, synthetic construct
  source 1..20: mol_type = other DNA
accacagggttgtcatggta

SEQ ID NO: 1708 - DNA, 20 bp, synthetic construct
  source 1..20: mol_type = other DNA
taaaattgcaattctatatc

SEQ ID NO: 1709 - DNA, 20 bp, synthetic construct
  source 1..20: mol_type = other DNA
gtaaatgtacacaggcacag

SEQ ID NO: 1710 - DNA, 20 bp, synthetic construct
  source 1..20: mol_type = other DNA
gactgcaaagtacttggcaa

SEQ ID NO: 1711 - DNA, 20 bp, synthetic construct
  source 1..20: mol_type = other DNA
gctccactacagctcaaagc

SEQ ID NO: 1712 - DNA, 20 bp, synthetic construct
  source 1..20: mol_type = other DNA
ttctcatgtaagctagtttc

SEQ ID NO: 1713 - DNA, 20 bp, synthetic construct
  source 1..20: mol_type = other DNA
cttgctttgacccccttctc

SEQ ID NO: 1714 - DNA, 20 bp, synthetic construct
  source 1..20: mol_type = other DNA
catttctagcaggaaccagc

SEQ ID NO: 1715 - DNA, 20 bp, synthetic construct
  source 1..20: mol_type = other DNA
ccaaagttggaaattctctt

SEQ ID NO: 1716 - DNA, 20 bp, synthetic construct
  source 1..20: mol_type = other DNA
agtgaggtatacaccagagc

SEQ ID NO: 1717 - DNA, 20 bp, synthetic construct
  source 1..20: mol_type = other DNA
tggctgagttagggcttcag

SEQ ID NO: 1718 - DNA, 20 bp, synthetic construct
  source 1..20: mol_type = other DNA
tttcaactaacaattcaggc

SEQ ID NO: 1719 - DNA, 20 bp, synthetic construct
  source 1..20: mol_type = other DNA
attttccattagctagaaag

SEQ ID NO: 1720 - DNA, 20 bp, synthetic construct
  source 1..20: mol_type = other DNA
agacattccttctctgtacc

SEQ ID NO: 1721 - DNA, 20 bp, synthetic construct
  source 1..20: mol_type = other DNA
acaccaagataacattgcta

SEQ ID NO: 1722 - DNA, 20 bp, synthetic construct
  source 1..20: mol_type = other DNA
tctatctttacctaaagcta

SEQ ID NO: 1723 - DNA, 20 bp, synthetic construct
  source 1..20: mol_type = other DNA
tgttattaaatcaaaacaaa

SEQ ID NO: 1724 - DNA, 20 bp, synthetic construct
  source 1..20: mol_type = other DNA
ggaaaagaacaacacaactc

SEQ ID NO: 1725 - DNA, 20 bp, synthetic construct
  source 1..20: mol_type = other DNA
atctctaattatcctggctg

SEQ ID NO: 1726 - DNA, 20 bp, synthetic construct
  source 1..20: mol_type = other DNA
gaaacatctttctggcacta

SEQ ID NO: 1727 - DNA, 20 bp, synthetic construct
  source 1..20: mol_type = other DNA
acctttatgttaaacctaac

SEQ ID NO: 1728 - DNA, 20 bp, synthetic construct
  source 1..20: mol_type = other DNA
attgtttttctgacattctt

SEQ ID NO: 1729 - DNA, 20 bp, synthetic construct
  source 1..20: mol_type = other DNA
agagaccagaatgaattcca

SEQ ID NO: 1730 - DNA, 20 bp, synthetic construct
  source 1..20: mol_type = other DNA
tcataatcaaagaattattc

SEQ ID NO: 1731 - DNA, 20 bp, synthetic construct
  source 1..20: mol_type = other DNA
atgtccaattttcctagttt

SEQ ID NO: 1732 - DNA, 20 bp, synthetic construct
  source 1..20: mol_type = other DNA
tatttggcccctatagatgg

SEQ ID NO: 1733 - DNA, 20 bp, synthetic construct
  source 1..20: mol_type = other DNA
cctttgtgacttgcagttgg

SEQ ID NO: 1734 - DNA, 20 bp, synthetic construct
  source 1..20: mol_type = other DNA
tggataataccccatgaaat

SEQ ID NO: 1735 - DNA, 20 bp, synthetic construct
  source 1..20: mol_type = other DNA
aactagccaatttttaatat

SEQ ID NO: 1736 - DNA, 20 bp, synthetic construct
  source 1..20: mol_type = other DNA
ggcaaaggcaaagagttaag

SEQ ID NO: 1737 - DNA, 20 bp, synthetic construct
  source 1..20: mol_type = other DNA
gagagaccttaatcactgca

SEQ ID NO: 1738 - DNA, 20 bp, synthetic construct
  source 1..20: mol_type = other DNA
caatatttgggctttgccac

SEQ ID NO: 1739 - DNA, 20 bp, synthetic construct
  source 1..20: mol_type = other DNA
cttgtagaaaatcccaatag

SEQ ID NO: 1740 - DNA, 20 bp, synthetic construct
  source 1..20: mol_type = other DNA
atgtgcatcattctaaaaca

SEQ ID NO: 1741 - DNA, 20 bp, synthetic construct
  source 1..20: mol_type = other DNA
ggaagtaccctttgagaaga

SEQ ID NO: 1742 - DNA, 20 bp, synthetic construct
  source 1..20: mol_type = other DNA
tacttgccaagatcattcaa

SEQ ID NO: 1743 - DNA, 20 bp, synthetic construct
  source 1..20: mol_type = other DNA
tgttacttgattctcacaac

SEQ ID NO: 1744 - DNA, 20 bp, synthetic construct
  source 1..20: mol_type = other DNA
taaaaccaatcagacttttt

SEQ ID NO: 1745 - DNA, 20 bp, synthetic construct
  source 1..20: mol_type = other DNA
cactcatcaagtaagaagag

SEQ ID NO: 1746 - DNA, 20 bp, synthetic construct
  source 1..20: mol_type = other DNA
tcttgattggtttcttacaa

SEQ ID NO: 1747 - DNA, 20 bp, synthetic construct
  source 1..20: mol_type = other DNA
gtgtttaagctgctatcttt

SEQ ID NO: 1748 - DNA, 20 bp, synthetic construct
  source 1..20: mol_type = other DNA
tgaggaagtaatattcaaca

SEQ ID NO: 1749 - DNA, 20 bp, synthetic construct
  source 1..20: mol_type = other DNA
acaggttaagatactagatt

SEQ ID NO: 1750 - DNA, 20 bp, synthetic construct
  source 1..20: mol_type = other DNA
caaagttgtaagtggcagca

SEQ ID NO: 1751 - DNA, 20 bp, synthetic construct
  source 1..20: mol_type = other DNA
tggaagcttatcttgtatac

SEQ ID NO: 1752 - DNA, 20 bp, synthetic construct
  source 1..20: mol_type = other DNA
tccagtctaagtacagactg

SEQ ID NO: 1753 - DNA, 20 bp, synthetic construct
  source 1..20: mol_type = other DNA
tcccacaaaactcatgcttt

SEQ ID NO: 1754 - DNA, 20 bp, synthetic construct
  source 1..20: mol_type = other DNA
gctgcacttgattattttag

SEQ ID NO: 1755 - DNA, 20 bp, synthetic construct
  source 1..20: mol_type = other DNA
ttcctggaagcttaccaact

SEQ ID NO: 1756 - DNA, 20 bp, synthetic construct
  source 1..20: mol_type = other DNA
gagtgagaagatgctgacaa

SEQ ID NO: 1757 - DNA, 20 bp, synthetic construct
  source 1..20: mol_type = other DNA
agcaaaatgactaaaagagg

SEQ ID NO: 1758 - DNA, 20 bp, synthetic construct
  source 1..20: mol_type = other DNA
tgcaaccccaaataagtaat

SEQ ID NO: 1759 - DNA, 20 bp, synthetic construct
  source 1..20: mol_type = other DNA
tatccaaagagttatctatc

SEQ ID NO: 1760 - DNA, 20 bp, synthetic construct
  source 1..20: mol_type = other DNA
tgtccaagcaagaatcagat

SEQ ID NO: 1761 - DNA, 20 bp, synthetic construct
  source 1..20: mol_type = other DNA
gtgacttacacagatccagg

SEQ ID NO: 1762 - DNA, 20 bp, synthetic construct
  source 1..20: mol_type = other DNA
ccaccatttcctcctctctc

SEQ ID NO: 1763 - DNA, 20 bp, synthetic construct
  source 1..20: mol_type = other DNA
ggttaagatactagattcag

SEQ ID NO: 1764 - DNA, 20 bp, synthetic construct
  source 1..20: mol_type = other DNA
cccacaaaactcatgctttc

SEQ ID NO: 1765 - DNA, 20 bp, synthetic construct
  source 1..20: mol_type = other DNA
ttgtgaagatatgacagagg

SEQ ID NO: 1766 - DNA, 20 bp, synthetic construct
  source 1..20: mol_type = other DNA
tactgcaattgttgaacagc

SEQ ID NO: 1767 - DNA, 20 bp, synthetic construct
  source 1..20: mol_type = other DNA
gagaccttaatcactgcaag

SEQ ID NO: 1768 - DNA, 20 bp, synthetic construct
  source 1..20: mol_type = other DNA
atttctagcaggaaccagct

SEQ ID NO: 1769 - DNA, 20 bp, synthetic construct
  source 1..20: mol_type = other DNA
gcaaaggcaaagagttaaga

SEQ ID NO: 1770 - DNA, 20 bp, synthetic construct
  source 1..20: mol_type = other DNA
ccacagggttgtcatggtag

SEQ ID NO: 1771 - DNA, 20 bp, synthetic construct
  source 1..20: mol_type = other DNA
tctgtttttaatgcacaacc

SEQ ID NO: 1772 - DNA, 20 bp, synthetic construct
  source 1..20: mol_type = other DNA
atgtgatctatatcaggaga

SEQ ID NO: 1773 - DNA, 20 bp, synthetic construct
  source 1..20: mol_type = other DNA
cataatcaaagaattattct

SEQ ID NO: 1774 - DNA, 20 bp, synthetic construct
  source 1..20: mol_type = other DNA
tgtccaattttcctagttta

SEQ ID NO: 1775 - DNA, 20 bp, synthetic construct
  source 1..20: mol_type = other DNA
cactacattcacagggcact

SEQ ID NO: 1776 - DNA, 20 bp, synthetic construct
  source 1..20: mol_type = other DNA
aaatgtacacaggcacagca

SEQ ID NO: 1777 - DNA, 20 bp, synthetic construct
  source 1..20: mol_type = other DNA
actagccaatttttaatatc

SEQ ID NO: 1778 - DNA, 20 bp, synthetic construct
  source 1..20: mol_type = other DNA
atcaaaacaaaacacaaggt

SEQ ID NO: 1779 - DNA, 20 bp, synthetic construct
  source 1..20: mol_type = other DNA
gtgtcttaaagtgctaagag

SEQ ID NO: 1780 - DNA, 20 bp, synthetic construct
  source 1..20: mol_type = other DNA
aaaattgcaattctatatca

SEQ ID NO: 1781 - DNA, 20 bp, synthetic construct
  source 1..20: mol_type = other DNA
gaactgtagtacaaatcttt

SEQ ID NO: 1782 - DNA, 20 bp, synthetic construct
  source 1..20: mol_type = other DNA
gagaccagaatgaattccat

SEQ ID NO: 1783 - DNA, 20 bp, synthetic construct
  source 1..20: mol_type = other DNA
ggattctaccaacaatcagg

SEQ ID NO: 1784 - DNA, 20 bp, synthetic construct
  source 1..20: mol_type = other DNA
ctccactacagctcaaagca

SEQ ID NO: 1785 - DNA, 20 bp, synthetic construct
  source 1..20: mol_type = other DNA
taataacatttctcaatgca

SEQ ID NO: 1786 - DNA, 20 bp, synthetic construct
  source 1..20: mol_type = other DNA
accaaatctgtttctgcaaa

SEQ ID NO: 1787 - DNA, 20 bp, synthetic construct
  source 1..20: mol_type = other DNA
atccaaagagttatctatcc

SEQ ID NO: 1788 - DNA, 20 bp, synthetic construct
  source 1..20: mol_type = other DNA
tgattggtttcttacaaaac

SEQ ID NO: 1789 - DNA, 20 bp, synthetic construct
  source 1..20: mol_type = other DNA
ggaaccttattctcttcctt

SEQ ID NO: 1790 - DNA, 20 bp, synthetic construct
  source 1..20: mol_type = other DNA
caccaagataacattgctaa

SEQ ID NO: 1791 - DNA, 20 bp, synthetic construct
  source 1..20: mol_type = other DNA
tgtgcatcattctaaaacaa

SEQ ID NO: 1792 - DNA, 20 bp, synthetic construct
  source 1..20: mol_type = other DNA
accttcaaatcacctacgat

SEQ ID NO: 1793 - DNA, 20 bp, synthetic construct
  source 1..20: mol_type = other DNA
ggataataccccatgaaatg

SEQ ID NO: 1794 - DNA, 20 bp, synthetic construct
  source 1..20: mol_type = other DNA
aggtgtaaggccagatgccc

SEQ ID NO: 1795 - DNA, 20 bp, synthetic construct
  source 1..20: mol_type = other DNA
acaaagacccttgtgctctg

SEQ ID NO: 1796 - DNA, 20 bp, synthetic construct
  source 1..20: mol_type = other DNA
tttttgtaaagctcttacat

SEQ ID NO: 1797 - DNA, 20 bp, synthetic construct
  source 1..20: mol_type = other DNA
tctttacctaaagctacaaa

SEQ ID NO: 1798 - DNA, 20 bp, synthetic construct
  source 1..20: mol_type = other DNA
tacacaactaattaacagaa

SEQ ID NO: 1799 - DNA, 20 bp, synthetic construct
  source 1..20: mol_type = other DNA
ggaagcttatcttgtatact

SEQ ID NO: 1800 - DNA, 20 bp, synthetic construct
  source 1..20: mol_type = other DNA
acattccttctctgtacctg

SEQ ID NO: 1801 - DNA, 20 bp, synthetic construct
  source 1..20: mol_type = other DNA
ttcaactaacaattcaggca

SEQ ID NO: 1802 - DNA, 20 bp, synthetic construct
  source 1..20: mol_type = other DNA
ggttacaccattagccacca

SEQ ID NO: 1803 - DNA, 20 bp, synthetic construct
  source 1..20: mol_type = other DNA
gcaaaatgactaaaagaggt

SEQ ID NO: 1804 - DNA, 20 bp, synthetic construct
  source 1..20: mol_type = other DNA
agactgaaatctgggagcta

SEQ ID NO: 1805 - DNA, 20 bp, synthetic construct
  source 1..20: mol_type = other DNA
actcatcaagtaagaagagg

SEQ ID NO: 1806 - DNA, 20 bp, synthetic construct
  source 1..20: mol_type = other DNA
agtaccctttgagaagaaat

SEQ ID NO: 1807 - DNA, 20 bp, synthetic construct
  source 1..20: mol_type = other DNA
gcaaccccaaataagtaata

SEQ ID NO: 1808 - DNA, 20 bp, synthetic construct
  source 1..20: mol_type = other DNA
ctgcaaagtacttggcaaca

SEQ ID NO: 1809 - DNA, 20 bp, synthetic construct
  source 1..20: mol_type = other DNA
gacttacacagatccaggtt

SEQ ID NO: 1810 - DNA, 20 bp, synthetic construct
  source 1..20: mol_type = other DNA
ctttatgttaaacctaactc

SEQ ID NO: 1811 - DNA, 20 bp, synthetic construct
  source 1..20: mol_type = other DNA
aagttgtaagtggcagcaat

SEQ ID NO: 1812 - DNA, 20 bp, synthetic construct
  source 1..20: mol_type = other DNA
gtaagataagtttctaaaag

SEQ ID NO: 1813 - DNA, 20 bp, synthetic construct
  source 1..20: mol_type = other DNA
gcccctatagatggcaagag

SEQ ID NO: 1814 - DNA, 20 bp, synthetic construct
  source 1..20: mol_type = other DNA
ttgctttgacccccttctcc

SEQ ID NO: 1815 - DNA, 20 bp, synthetic construct
  source 1..20: mol_type = other DNA
ggctgagttagggcttcagt

SEQ ID NO: 1816 - DNA, 20 bp, synthetic construct
  source 1..20: mol_type = other DNA
cagacgacaacaggcttgca

SEQ ID NO: 1817 - DNA, 20 bp, synthetic construct
  source 1..20: mol_type = other DNA
ttttccattagctagaaaga

SEQ ID NO: 1818 - DNA, 20 bp, synthetic construct
  source 1..20: mol_type = other DNA
aaggaaacactttcagttga

SEQ ID NO: 1819 - DNA, 20 bp, synthetic construct
  source 1..20: mol_type = other DNA
acttgccaagatcattcaaa

SEQ ID NO: 1820 - DNA, 20 bp, synthetic construct
  source 1..20: mol_type = other DNA
cagattactcaaattgagat

SEQ ID NO: 1821 - DNA, 20 bp, synthetic construct
  source 1..20: mol_type = other DNA
ctcatgtaagctagtttcct

SEQ ID NO: 1822 - DNA, 20 bp, synthetic construct
  source 1..20: mol_type = other DNA
tagtcaaatcatgtggacaa

SEQ ID NO: 1823 - DNA, 20 bp, synthetic construct
  source 1..20: mol_type = other DNA
ttgtagaaaatcccaataga

SEQ ID NO: 1824 - DNA, 20 bp, synthetic construct
  source 1..20: mol_type = other DNA
gctaaagtttttgaaactta

SEQ ID NO: 1825 - DNA, 20 bp, synthetic construct
  source 1..20: mol_type = other DNA
gtgaggtatacaccagagcg

SEQ ID NO: 1826 - DNA, 20 bp, synthetic construct
  source 1..20: mol_type = other DNA
tcaggagatgcttgaaaatt

SEQ ID NO: 1827 - DNA, 20 bp, synthetic construct
  source 1..20: mol_type = other DNA
agtgagaagatgctgacaac

SEQ ID NO: 1828 - DNA, 20 bp, synthetic construct
  source 1..20: mol_type = other DNA
aaaaccaatcagactttttt

SEQ ID NO: 1829 - DNA, 20 bp, synthetic construct
  source 1..20: mol_type = other DNA
gttacttgattctcacaacc

SEQ ID NO: 1830 - DNA, 20 bp, synthetic construct
  source 1..20: mol_type = other DNA
gacccagaatccttactttg

SEQ ID NO: 1831 - DNA, 20 bp, synthetic construct
  source 1..20: mol_type = other DNA
tgtgacttgcagttgggaag

SEQ ID NO: 1832 - DNA, 20 bp, synthetic construct
  source 1..20: mol_type = other DNA
tgtttttctgacattctttt

SEQ ID NO: 1833 - DNA, 20 bp, synthetic construct
  source 1..20: mol_type = other DNA
tccaagcaagaatcagattt

SEQ ID NO: 1834 - DNA, 20 bp, synthetic construct
  source 1..20: mol_type = other DNA
tgtattaattacttaggctt

SEQ ID NO: 1835 - DNA, 20 bp, synthetic construct
  source 1..20: mol_type = other DNA
gaaaagaacaacacaactct

SEQ ID NO: 1836 - DNA, 20 bp, synthetic construct
  source 1..20: mol_type = other DNA
acttgattattttagtcagt

SEQ ID NO: 1837 - DNA, 20 bp, synthetic construct
  source 1..20: mol_type = other DNA
tcctggaagcttaccaactg

SEQ ID NO: 1838 - DNA, 20 bp, synthetic construct
  source 1..20: mol_type = other DNA
gttgtaagtggcagcaatca

SEQ ID NO: 1839 - DNA, 20 bp, synthetic construct
  source 1..20: mol_type = other DNA
aaaccaatcagacttttttt

SEQ ID NO: 1840 - DNA, 20 bp, synthetic construct
  source 1..20: mol_type = other DNA
ggtatacaccagagcgagca

SEQ ID NO: 1841 - DNA, 20 bp, synthetic construct
  source 1..20: mol_type = other DNA
cacagggttgtcatggtagc

SEQ ID NO: 1842 - DNA, 20 bp, synthetic construct
  source 1..20: mol_type = other DNA
ccttcaaatcacctacgatg

SEQ ID NO: 1843 - DNA, 20 bp, synthetic construct
  source 1..20: mol_type = other DNA
tgtttttaatgcacaaccta

SEQ ID NO: 1844 - DNA, 20 bp, synthetic construct
  source 1..20: mol_type = other DNA
tgattattttagtcagtgtc

SEQ ID NO: 1845 - DNA, 20 bp, synthetic construct
  source 1..20: mol_type = other DNA
agattactcaaattgagatt

SEQ ID NO: 1846 - DNA, 20 bp, synthetic construct
  source 1..20: mol_type = other DNA
tcaaaacaaaacacaaggta

SEQ ID NO: 1847 - DNA, 20 bp, synthetic construct
  source 1..20: mol_type = other DNA
tctttgggactctgactcca

SEQ ID NO: 1848 - DNA, 20 bp, synthetic construct
  source 1..20: mol_type = other DNA
tgcatcattctaaaacaaat

SEQ ID NO: 1849 - DNA, 20 bp, synthetic construct
  source 1..20: mol_type = other DNA
aagctacaaacttctctttt

SEQ ID NO: 1850 - DNA, 20 bp, synthetic construct
  source 1..20: mol_type = other DNA
tgtggttagagcctcgctat

SEQ ID NO: 1851 - DNA, 20 bp, synthetic construct
  source 1..20: mol_type = other DNA
aaagaacaacacaactcttt

SEQ ID NO: 1852 - DNA, 20 bp, synthetic construct
  source 1..20: mol_type = other DNA
ttaatcaatcagtacttgct

SEQ ID NO: 1853 - DNA, 20 bp, synthetic construct
  source 1..20: mol_type = other DNA
caggagatgcttgaaaattc

SEQ ID NO: 1854 - DNA, 20 bp, synthetic construct
  source 1..20: mol_type = other DNA
aactgtagtacaaatctttc

SEQ ID NO: 1855 - DNA, 20 bp, synthetic construct
  source 1..20: mol_type = other DNA
gttaagatactagattcagc

SEQ ID NO: 1856 - DNA, 20 bp, synthetic construct
  source 1..20: mol_type = other DNA
gattggtttcttacaaaaca

SEQ ID NO: 1857 - DNA, 20 bp, synthetic construct
  source 1..20: mol_type = other DNA
gttacaccattagccaccag

SEQ ID NO: 1858 - DNA, 20 bp, synthetic construct
  source 1..20: mol_type = other DNA
acattcttttttcttctatc

SEQ ID NO: 1859 - DNA, 20 bp, synthetic construct
  source 1..20: mol_type = other DNA
tggaagcttaccaactgaat

SEQ ID NO: 1860 - DNA, 20 bp, synthetic construct
  source 1..20: mol_type = other DNA
gtgagaagatgctgacaaca

SEQ ID NO: 1861 - DNA, 20 bp, synthetic construct
  source 1..20: mol_type = other DNA
actacattcacagggcactg

SEQ ID NO: 1862 - DNA, 20 bp, synthetic construct
  source 1..20: mol_type = other DNA
gattctaccaacaatcagga

SEQ ID NO: 1863 - DNA, 20 bp, synthetic construct
  source 1..20: mol_type = other DNA
accaagataacattgctaag

SEQ ID NO: 1864 - DNA, 20 bp, synthetic construct
  source 1..20: mol_type = other DNA
ataacatttctcaatgcaac

SEQ ID NO: 1865 - DNA, 20 bp, synthetic construct
  source 1..20: mol_type = other DNA
ggaacctttgaaaggtgagg

SEQ ID NO: 1866 - DNA, 20 bp, synthetic construct
  source 1..20: mol_type = other DNA
agacgacaacaggcttgcag

SEQ ID NO: 1867 - DNA, 20 bp, synthetic construct
  source 1..20: mol_type = other DNA
gaatccttactttgtttcat

SEQ ID NO: 1868 - DNA, 20 bp, synthetic construct
  source 1..20: mol_type = other DNA
gtaaggccagatgccccctt

SEQ ID NO: 1869 - DNA, 20 bp, synthetic construct
  source 1..20: mol_type = other DNA
aaaccaggttccagggctct

SEQ ID NO: 1870 - DNA, 20 bp, synthetic construct
  source 1..20: mol_type = other DNA
tttctagcaggaaccagcta

SEQ ID NO: 1871 - DNA, 20 bp, synthetic construct
  source 1..20: mol_type = other DNA
gctgagttagggcttcagta

SEQ ID NO: 1872 - DNA, 20 bp, synthetic construct
  source 1..20: mol_type = other DNA
ctcatcaagtaagaagaggg

SEQ ID NO: 1873 - DNA, 20 bp, synthetic construct
  source 1..20: mol_type = other DNA
tgtagaaaatcccaatagat

SEQ ID NO: 1874 - DNA, 20 bp, synthetic construct
  source 1..20: mol_type = other DNA
ataatcaaagaattattctc

SEQ ID NO: 1875 - DNA, 20 bp, synthetic construct
  source 1..20: mol_type = other DNA
gtaccctttgagaagaaatt

SEQ ID NO: 1876 - DNA, 20 bp, synthetic construct
  source 1..20: mol_type = other DNA
agacccttgtgctctgcaca

SEQ ID NO: 1877 - DNA, 20 bp, synthetic construct
  source 1..20: mol_type = other DNA
tcaactaacaattcaggcag

SEQ ID NO: 1878 - DNA, 20 bp, synthetic construct
  source 1..20: mol_type = other DNA
gaatcagattttagattcta

SEQ ID NO: 1879 - DNA, 20 bp, synthetic construct
  source 1..20: mol_type = other DNA
tctctgtacctgagcatctt

SEQ ID NO: 1880 - DNA, 20 bp, synthetic construct
  source 1..20: mol_type = other DNA
caaccccaaataagtaataa

SEQ ID NO: 1881 - DNA, 20 bp, synthetic construct
  source 1..20: mol_type = other DNA
agaccagaatgaattccatt

SEQ ID NO: 1882 - DNA, 20 bp, synthetic construct
  source 1..20: mol_type = other DNA
ttttgtaaagctcttacatc

SEQ ID NO: 1883 - DNA, 20 bp, synthetic construct
  source 1..20: mol_type = other DNA
tttatgttaaacctaactct

SEQ ID NO: 1884 - DNA, 20 bp, synthetic construct
  source 1..20: mol_type = other DNA
cttggatttttgtattcaag

SEQ ID NO: 1885 - DNA, 20 bp, synthetic construct
  source 1..20: mol_type = other DNA
cccctatagatggcaagagg

SEQ ID NO: 1886 - DNA, 20 bp, synthetic construct
  source 1..20: mol_type = other DNA
ctagccaatttttaatatca

SEQ ID NO: 1887 - DNA, 20 bp, synthetic construct
  source 1..20: mol_type = other DNA
caaaggcaaagagttaagat

SEQ ID NO: 1888 - DNA, 20 bp, synthetic construct
  source 1..20: mol_type = other DNA
tttccattagctagaaagaa

SEQ ID NO: 1889 - DNA, 20 bp, synthetic construct
  source 1..20: mol_type = other DNA
ggaaacactttcagttgatt

SEQ ID NO: 1890 - DNA, 20 bp, synthetic construct
  source 1..20: mol_type = other DNA
gaagcttatcttgtatactg

SEQ ID NO: 1891 - DNA, 20 bp, synthetic construct
  source 1..20: mol_type = other DNA
ccaaatctgtttctgcaaag

SEQ ID NO: 1892 - DNA, 20 bp, synthetic construct
  source 1..20: mol_type = other DNA
tacttgattctcacaaccct

SEQ ID NO: 1893 - DNA, 20 bp, synthetic construct
  source 1..20: mol_type = other DNA
aaattgcaattctatatcag

SEQ ID NO: 1894 - DNA, 20 bp, synthetic construct
  source 1..20: mol_type = other DNA
tgctttgacccccttctccc

SEQ ID NO: 1895 - DNA, 20 bp, synthetic construct
  source 1..20: mol_type = other DNA
gcaaagtacttggcaacatt

SEQ ID NO: 1896 - DNA, 20 bp, synthetic construct
  source 1..20: mol_type = other DNA
actgcaattgttgaacagca

SEQ ID NO: 1897 - DNA, 20 bp, synthetic construct
  source 1..20: mol_type = other DNA
tccactacagctcaaagcaa

SEQ ID NO: 1898 - DNA, 20 bp, synthetic construct
  source 1..20: mol_type = other DNA
gataataccccatgaaatga

SEQ ID NO: 1899 - DNA, 20 bp, synthetic construct
  source 1..20: mol_type = other DNA
tgacttagagtcatagggtg

SEQ ID NO: 1900 - DNA, 20 bp, synthetic construct
  source 1..20: mol_type = other DNA
aggtcatttggaactgcagg

SEQ ID NO: 1901 - DNA, 20 bp, synthetic construct
  source 1..20: mol_type = other DNA
gtgatctatatcaggagaaa

SEQ ID NO: 1902 - DNA, 20 bp, synthetic construct
  source 1..20: mol_type = other DNA
aaaatgactaaaagaggtac

SEQ ID NO: 1903 - DNA, 20 bp, synthetic construct
  source 1..20: mol_type = other DNA
gtcaaatcatgtggacaagg

SEQ ID NO: 1904 - DNA, 20 bp, synthetic construct
  source 1..20: mol_type = other DNA
tccaaagagttatctatcct

SEQ ID NO: 1905 - DNA, 20 bp, synthetic construct
  source 1..20: mol_type = other DNA
taagataagtttctaaaagt

SEQ ID NO: 1906 - DNA, 20 bp, synthetic construct
  source 1..20: mol_type = other DNA
gactgaaatctgggagctat

SEQ ID NO: 1907 - DNA, 20 bp, synthetic construct
  source 1..20: mol_type = other DNA
gcacacaagaagtcacaggc

SEQ ID NO: 1908 - DNA, 20 bp, synthetic construct
  source 1..20: mol_type = other DNA
tccaattttcctagtttaaa

SEQ ID NO: 1909 - DNA, 20 bp, synthetic construct
  source 1..20: mol_type = other DNA
acacaactaattaacagaaa

SEQ ID NO: 1910 - DNA, 20 bp, synthetic construct
  source 1..20: mol_type = other DNA
acttacacagatccaggttc

SEQ ID NO: 1911 - DNA, 20 bp, synthetic construct
  source 1..20: mol_type = other DNA
tgtgaagatatgacagaggc

SEQ ID NO: 1912 - DNA, 20 bp, synthetic construct
  source 1..20: mol_type = other DNA
gtgacttgcagttgggaagt

SEQ ID NO: 1913 - DNA, 20 bp, synthetic construct
  source 1..20: mol_type = other DNA
agaccttaatcactgcaaga

SEQ ID NO: 1914 - DNA, 20 bp, synthetic construct
  source 1..20: mol_type = other DNA
tcatgtaagctagtttcctt

SEQ ID NO: 1915 - DNA, 20 bp, synthetic construct
  source 1..20: mol_type = other DNA
caaaacaaaacacaaggtac

SEQ ID NO: 1916 - DNA, 20 bp, synthetic construct
  source 1..20: mol_type = other DNA
caactaacaattcaggcagc

SEQ ID NO: 1917 - DNA, 20 bp, synthetic construct
  source 1..20: mol_type = other DNA
gaacctttgaaaggtgaggc

SEQ ID NO: 1918 - DNA, 20 bp, synthetic construct
  source 1..20: mol_type = other DNA
tagccaatttttaatatcat

SEQ ID NO: 1919 - DNA, 20 bp, synthetic construct
  source 1..20: mol_type = other DNA
cacaactaattaacagaaaa

SEQ ID NO: 1920 - DNA, 20 bp, synthetic construct
  source 1..20: mol_type = other DNA
accaggttccagggctctcc

SEQ ID NO: 1921 - DNA, 20 bp, synthetic construct
  source 1..20: mol_type = other DNA
caattgttgaacagcagtgc

SEQ ID NO: 1922 - DNA, 20 bp, synthetic construct
  source 1..20: mol_type = other DNA
acagggttgtcatggtagct

SEQ ID NO: 1923 - DNA, 20 bp, synthetic construct
  source 1..20: mol_type = other DNA
tgaaatctgggagctattca

SEQ ID NO: 1924 - DNA, 20 bp, synthetic construct
  source 1..20: mol_type = other DNA
tcatcaagtaagaagagggc

SEQ ID NO: 1925 - DNA, 20 bp, synthetic construct
  source 1..20: mol_type = other DNA
gtagaaaatcccaatagatt

SEQ ID NO: 1926 - DNA, 20 bp, synthetic construct
  source 1..20: mol_type = other DNA
ccactacagctcaaagcaag

SEQ ID NO: 1927 - DNA, 20 bp, synthetic construct
  source 1..20: mol_type = other DNA
acgacaacaggcttgcagac

SEQ ID NO: 1928 - DNA, 20 bp, synthetic construct
  source 1..20: mol_type = other DNA
acacagatccaggttcatca

SEQ ID NO: 1929 - DNA, 20 bp, synthetic construct
  source 1..20: mol_type = other DNA
ttccattagctagaaagaac

SEQ ID NO: 1930 - DNA, 20 bp, synthetic construct
  source 1..20: mol_type = other DNA
ctgagttagggcttcagtag

SEQ ID NO: 1931 - DNA, 20 bp, synthetic construct
  source 1..20: mol_type = other DNA
gaactgtttcttgcaacagc

SEQ ID NO: 1932 - DNA, 20 bp, synthetic construct
  source 1..20: mol_type = other DNA
tgagaagatgctgacaacac

SEQ ID NO: 1933 - DNA, 20 bp, synthetic construct
  source 1..20: mol_type = other DNA
ttggtttcttacaaaacatt

SEQ ID NO: 1934 - DNA, 20 bp, synthetic construct
  source 1..20: mol_type = other DNA
gaccttaatcactgcaagac

SEQ ID NO: 1935 - DNA, 20 bp, synthetic construct
  source 1..20: mol_type = other DNA
acttagagtcatagggtgct

SEQ ID NO: 1936 - DNA, 20 bp, synthetic construct
  source 1..20: mol_type = other DNA
caaagtacttggcaacatta

SEQ ID NO: 1937 - DNA, 20 bp, synthetic construct
  source 1..20: mol_type = other DNA
acttgcagttgggaagtcat

SEQ ID NO: 1938 - DNA, 20 bp, synthetic construct
  source 1..20: mol_type = other DNA
tttgtaaagctcttacatct

SEQ ID NO: 1939 - DNA, 20 bp, synthetic construct
  source 1..20: mol_type = other DNA
gcatcattctaaaacaaatc

SEQ ID NO: 1940 - DNA, 20 bp, synthetic construct
  source 1..20: mol_type = other DNA
ccaaagagttatctatcctg

SEQ ID NO: 1941 - DNA, 20 bp, synthetic construct
  source 1..20: mol_type = other DNA
acttgattctcacaaccctg

SEQ ID NO: 1942 - DNA, 20 bp, synthetic construct
  source 1..20: mol_type = other DNA
tgtttcctatactccccact

SEQ ID NO: 1943 - DNA, 20 bp, synthetic construct
  source 1..20: mol_type = other DNA
aagatactagattcagccta

SEQ ID NO: 1944 - DNA, 20 bp, synthetic construct
  source 1..20: mol_type = other DNA
aaatgactaaaagaggtaca

SEQ ID NO: 1945 - DNA, 20 bp, synthetic construct
  source 1..20: mol_type = other DNA
ccaattttcctagtttaaaa

SEQ ID NO: 1946 - DNA, 20 bp, synthetic construct
  source 1..20: mol_type = other DNA
aaatctgtttctgcaaaggc

SEQ ID NO: 1947 - DNA, 20 bp, synthetic construct
  source 1..20: mol_type = other DNA
gctttgacccccttctccca

SEQ ID NO: 1948 - DNA, 20 bp, synthetic construct
  source 1..20: mol_type = other DNA
gtgaagatatgacagaggcc

SEQ ID NO: 1949 - DNA, 20 bp, synthetic construct
  source 1..20: mol_type = other DNA
gattactcaaattgagattc

SEQ ID NO: 1950 - DNA, 20 bp, synthetic construct
  source 1..20: mol_type = other DNA
tctaccaacaatcaggatcc

SEQ ID NO: 1951 - DNA, 20 bp, synthetic construct
  source 1..20: mol_type = other DNA
ttatcttgtatactggtttg

SEQ ID NO: 1952 - DNA, 20 bp, synthetic construct
  source 1..20: mol_type = other DNA
tacattcacagggcactgta

SEQ ID NO: 1953 - DNA, 20 bp, synthetic construct
  source 1..20: mol_type = other DNA
ttttttcttctatcttcagt

SEQ ID NO: 1954 - DNA, 20 bp, synthetic construct
  source 1..20: mol_type = other DNA
caattgtagccggctggcta

SEQ ID NO: 1955 - DNA, 20 bp, synthetic construct
  source 1..20: mol_type = other DNA
tctgcacacattactctgag

SEQ ID NO: 1956 - DNA, 20 bp, synthetic construct
  source 1..20: mol_type = other DNA
ttctagcaggaaccagctat

SEQ ID NO: 1957 - DNA, 20 bp, synthetic construct
  source 1..20: mol_type = other DNA
ttatgttaaacctaactctt

SEQ ID NO: 1958 - DNA, 20 bp, synthetic construct
  source 1..20: mol_type = other DNA
aaggccagatgcccccttcg

SEQ ID NO: 1959 - DNA, 20 bp, synthetic construct
  source 1..20: mol_type = other DNA
gagatgcttgaaaattcaat

SEQ ID NO: 1960 - DNA, 20 bp, synthetic construct
  source 1..20: mol_type = other DNA
aaccccaaataagtaataaa

SEQ ID NO: 1961 - DNA, 20 bp, synthetic construct
  source 1..20: mol_type = other DNA
aaaggcaaagagttaagatg

SEQ ID NO: 1962 - DNA, 20 bp, synthetic construct
  source 1..20: mol_type = other DNA
ctgacattagataggattcc

SEQ ID NO: 1963 - DNA, 20 bp, synthetic construct
  source 1..20: mol_type = other DNA
gaaacactttcagttgatta

SEQ ID NO: 1964 - DNA, 20 bp, synthetic construct
  source 1..20: mol_type = other DNA
cacacaagaagtcacaggct

SEQ ID NO: 1965 - DNA, 20 bp, synthetic construct
  source 1..20: mol_type = other DNA
gtggttagagcctcgctatt

SEQ ID NO: 1966 - DNA, 20 bp, synthetic construct
  source 1..20: mol_type = other DNA
taccctttgagaagaaatta

SEQ ID NO: 1967 - DNA, 20 bp, synthetic construct
  source 1..20: mol_type = other DNA
ataataccccatgaaatgag

SEQ ID NO: 1968 - DNA, 20 bp, synthetic construct
  source 1..20: mol_type = other DNA
actgtagtacaaatctttcc

SEQ ID NO: 1969 - DNA, 20 bp, synthetic construct
  source 1..20: mol_type = other DNA
aattgcaattctatatcaga

SEQ ID NO: 1970 - DNA, 20 bp, synthetic construct
  source 1..20: mol_type = other DNA
cttcaaatcacctacgatga

SEQ ID NO: 1971 - DNA, 20 bp, synthetic construct
  source 1..20: mol_type = other DNA
gaccagaatgaattccattt

SEQ ID NO: 1972 - DNA, 20 bp, synthetic construct
  source 1..20: mol_type = other DNA
tcagcaattcaaatagcaag

SEQ ID NO: 1973 - DNA, 20 bp, synthetic construct
  source 1..20: mol_type = other DNA
ttacaccattagccaccagc

SEQ ID NO: 1974 - DNA, 20 bp, synthetic construct
  source 1..20: mol_type = other DNA
ttttagtcagtgtctccagg

SEQ ID NO: 1975 - DNA, 20 bp, synthetic construct
  source 1..20: mol_type = other DNA
tgtaagctagtttccttcta

SEQ ID NO: 1976 - DNA, 20 bp, synthetic construct
  source 1..20: mol_type = other DNA
tgatctatatcaggagaaaa

SEQ ID NO: 1977 - DNA, 20 bp, synthetic construct
  source 1..20: mol_type = other DNA
ccctatagatggcaagagga

SEQ ID NO: 1978 - DNA, 20 bp, synthetic construct
  source 1..20: mol_type = other DNA
aagataagtttctaaaagtt

SEQ ID NO: 1979 - DNA, 20 bp, synthetic construct
  source 1..20: mol_type = other DNA
taatcaatcagtacttgctg

SEQ ID NO: 1980 - DNA, 20 bp, synthetic construct
  source 1..20: mol_type = other DNA
taatcaaagaattattctcc

SEQ ID NO: 1981 - DNA, 20 bp, synthetic construct
  source 1..20: mol_type = other DNA
ccaagataacattgctaagt

SEQ ID NO: 1982 - DNA, 20 bp, synthetic construct
  source 1..20: mol_type = other DNA
cagattttagattctaactg

SEQ ID NO: 1983 - DNA, 20 bp, synthetic construct
  source 1..20: mol_type = other DNA
aaccaatcagactttttttt

SEQ ID NO: 1984 - DNA, 20 bp, synthetic construct
  source 1..20: mol_type = other DNA
ggttggaaaggaagtctttc

SEQ ID NO: 1985 - DNA, 20 bp, synthetic construct
  source 1..20: mol_type = other DNA
gtatacaccagagcgagcac

SEQ ID NO: 1986 - DNA, 20 bp, synthetic construct
  source 1..20: mol_type = other DNA
ggaagcttaccaactgaata

SEQ ID NO: 1987 - DNA, 20 bp, synthetic construct
  source 1..20: mol_type = other DNA
aagaacaacacaactcttta

SEQ ID NO: 1988 - DNA, 20 bp, synthetic construct
  source 1..20: mol_type = other DNA
tgtacctgagcatctttcct

SEQ ID NO: 1989 - DNA, 20 bp, synthetic construct
  source 1..20: mol_type = other DNA
ttgtaagtggcagcaatcat

SEQ ID NO: 1990 - DNA, 20 bp, synthetic construct
  source 1..20: mol_type = other DNA
ggatttttgtattcaagcat

SEQ ID NO: 1991 - DNA, 20 bp, synthetic construct
  source 1..20: mol_type = other DNA
acatttctcaatgcaactca

SEQ ID NO: 1992 - DNA, 20 bp, synthetic construct
  source 1..20: mol_type = other DNA
ttactcaaattgagattcaa

SEQ ID NO: 1993 - DNA, 20 bp, synthetic construct
  source 1..20: mol_type = other DNA
aagctataaacaattcagta

SEQ ID NO: 1994 - DNA, 20 bp, synthetic construct
  source 1..20: mol_type = other DNA
acaccattagccaccagcaa

SEQ ID NO: 1995 - DNA, 20 bp, synthetic construct
  source 1..20: mol_type = other DNA
ctctccagcctccttcttcg

SEQ ID NO: 1996 - DNA, 20 bp, synthetic construct
  source 1..20: mol_type = other DNA
aatctgtttctgcaaaggca

SEQ ID NO: 1997 - DNA, 20 bp, synthetic construct
  source 1..20: mol_type = other DNA
atcttgtatactggtttgaa

SEQ ID NO: 1998 - DNA, 20 bp, synthetic construct
  source 1..20: mol_type = other DNA
gtttcttacaaaacattttc

SEQ ID NO: 1999 - DNA, 20 bp, synthetic construct
  source 1..20: mol_type = other DNA
actatcagcaagacctggga

SEQ ID NO: 2000 - DNA, 20 bp, synthetic construct
  source 1..20: mol_type = other DNA
taataccccatgaaatgagc

SEQ ID NO: 2001 - DNA, 20 bp, synthetic construct
  source 1..20: mol_type = other DNA
aatgactaaaagaggtacat

SEQ ID NO: 2002 - DNA, 20 bp, synthetic construct
  source 1..20: mol_type = other DNA
cgtctacacagattctacgc

SEQ ID NO: 2003 - DNA, 20 bp, synthetic construct
  source 1..20: mol_type = other DNA
taagctagtttccttctatt

SEQ ID NO: 2004 - DNA, 20 bp, synthetic construct
  source 1..20: mol_type = other DNA
aatcaaagaattattctcca

SEQ ID NO: 2005 - DNA, 20 bp, synthetic construct
  source 1..20: mol_type = other DNA
caagataacattgctaagta

SEQ ID NO: 2006 - DNA, 20 bp, synthetic construct
  source 1..20: mol_type = other DNA
acaccagagcgagcacctta

SEQ ID NO: 2007 - DNA, 20 bp, synthetic construct
  source 1..20: mol_type = other DNA
aaaacaaaacacaaggtacg

SEQ ID NO: 2008 - DNA, 20 bp, synthetic construct
  source 1..20: mol_type = other DNA
tgtaaagctcttacatctcc

SEQ ID NO: 2009 - DNA, 20 bp, synthetic construct
  source 1..20: mol_type = other DNA
atgatgtacacattccaatt

SEQ ID NO: 2010 - DNA, 20 bp, synthetic construct
  source 1..20: mol_type = other DNA
attgcaattctatatcagaa

SEQ ID NO: 2011 - DNA, 20 bp, synthetic construct
  source 1..20: mol_type = other DNA
acacaagaagtcacaggctc

SEQ ID NO: 2012 - DNA, 20 bp, synthetic construct
  source 1..20: mol_type = other DNA
caagggactgtgttgatcct

SEQ ID NO: 2013 - DNA, 20 bp, synthetic construct
  source 1..20: mol_type = other DNA
tgtaagtggcagcaatcatg

SEQ ID NO: 2014 - DNA, 20 bp, synthetic construct
  source 1..20: mol_type = other DNA
ccagaatgaattccattttg

SEQ ID NO: 2015 - DNA, 20 bp, synthetic construct
  source 1..20: mol_type = other DNA
accctttgagaagaaattac

SEQ ID NO: 2016 - DNA, 20 bp, synthetic construct
  source 1..20: mol_type = other DNA
tctagcaggaaccagctatg

SEQ ID NO: 2017 - DNA, 20 bp, synthetic construct
  source 1..20: mol_type = other DNA
agaacaacacaactctttac

SEQ ID NO: 2018 - DNA, 20 bp, synthetic construct
  source 1..20: mol_type = other DNA
tagaaaatcccaatagattc

SEQ ID NO: 2019 - DNA, 20 bp, synthetic construct
  source 1..20: mol_type = other DNA
accccaaataagtaataaac

SEQ ID NO: 2020 - DNA, 20 bp, synthetic construct
  source 1..20: mol_type = other DNA
catcattctaaaacaaatca

SEQ ID NO: 2021 - DNA, 20 bp, synthetic construct
  source 1..20: mol_type = other DNA
ggaagactaggtgaacatgc

SEQ ID NO: 2022 - DNA, 20 bp, synthetic construct
  source 1..20: mol_type = other DNA
gtttatgtgaattcagtaca

SEQ ID NO: 2023 - DNA, 20 bp, synthetic construct
  source 1..20: mol_type = other DNA
gcttcagaggatgtttttgg

SEQ ID NO: 2024 - DNA, 20 bp, synthetic construct
  source 1..20: mol_type = other DNA
attttcctagtttaaaaaac

SEQ ID NO: 2025 - DNA, 20 bp, synthetic construct
  source 1..20: mol_type = other DNA
cttgcagttgggaagtcatc

SEQ ID NO: 2026 - DNA, 20 bp, synthetic construct
  source 1..20: mol_type = other DNA
tgagttagggcttcagtagt

SEQ ID NO: 2027 - DNA, 20 bp, synthetic construct
  source 1..20: mol_type = other DNA
tgagaaaagatccattgggc

SEQ ID NO: 2028 - DNA, 20 bp, synthetic construct
  source 1..20: mol_type = other DNA
tgacattagataggattcct

SEQ ID NO: 2029 - DNA, 20 bp, synthetic construct
  source 1..20: mol_type = other DNA
aactaacaattcaggcagcc

SEQ ID NO: 2030 - DNA, 20 bp, synthetic construct
  source 1..20: mol_type = other DNA
tatgttaaacctaactctta

SEQ ID NO: 2031 - DNA, 20 bp, synthetic construct
  source 1..20: mol_type = other DNA
aattgttgaacagcagtgca

SEQ ID NO: 2032 - DNA, 20 bp, synthetic construct
  source 1..20: mol_type = other DNA
gacaacaggcttgcagacaa

SEQ ID NO: 2033 - DNA, 20 bp, synthetic construct
  source 1..20: mol_type = other DNA
gtcatggtagctgttatcaa

SEQ ID NO: 2034 - DNA, 20 bp, synthetic construct
  source 1..20: mol_type = other DNA
ctaccaacaatcaggatcct

SEQ ID NO: 2035 - DNA, 20 bp, synthetic construct
  source 1..20: mol_type = other DNA
gatctatatcaggagaaaat

SEQ ID NO: 2036 - DNA, 20 bp, synthetic construct
  source 1..20: mol_type = other DNA
gtaaatcatgaatacagctt

SEQ ID NO: 2037 - DNA, 20 bp, synthetic construct
  source 1..20: mol_type = other DNA
ctttgacccccttctcccag

SEQ ID NO: 2038 - DNA, 20 bp, synthetic construct
  source 1..20: mol_type = other DNA
accttaatcactgcaagact

SEQ ID NO: 2039 - DNA, 20 bp, synthetic construct
  source 1..20: mol_type = other DNA
tgaggaagtggtgattcagt

SEQ ID NO: 2040 - DNA, 20 bp, synthetic construct
  source 1..20: mol_type = other DNA
gaaatctgggagctattcag

SEQ ID NO: 2041 - DNA, 20 bp, synthetic construct
  source 1..20: mol_type = other DNA
agataagtttctaaaagttt

SEQ ID NO: 2042 - DNA, 20 bp, synthetic construct
  source 1..20: mol_type = other DNA
aagtacttggcaacattaca

SEQ ID NO: 2043 - DNA, 20 bp, synthetic construct
  source 1..20: mol_type = other DNA
caaagagttatctatcctgt

SEQ ID NO: 2044 - DNA, 20 bp, synthetic construct
  source 1..20: mol_type = other DNA
agatgcttgaaaattcaatt

SEQ ID NO: 2045 - DNA, 20 bp, synthetic construct
  source 1..20: mol_type = other DNA
aaggcaaagagttaagatgg

SEQ ID NO: 2046 - DNA, 20 bp, synthetic construct
  source 1..20: mol_type = other DNA
gtacctgagcatctttcctt

SEQ ID NO: 2047 - DNA, 20 bp, synthetic construct
  source 1..20: mol_type = other DNA
cagcaattcaaatagcaagc

SEQ ID NO: 2048 - DNA, 20 bp, synthetic construct
  source 1..20: mol_type = other DNA
tccattagctagaaagaacg

SEQ ID NO: 2049 - DNA, 20 bp, synthetic construct
  source 1..20: mol_type = other DNA
gatttttgtattcaagcatt

SEQ ID NO: 2050 - DNA, 20 bp, synthetic construct
  source 1..20: mol_type = other DNA
ttttttaacccaaagttaac

SEQ ID NO: 2051 - DNA, 20 bp, synthetic construct
  source 1..20: mol_type = other DNA
gctaagccagctgggcacca

SEQ ID NO: 2052 - DNA, 20 bp, synthetic construct
  source 1..20: mol_type = other DNA
gagaagatgctgacaacacc

SEQ ID NO: 2053 - DNA, 20 bp, synthetic construct
  source 1..20: mol_type = other DNA
agatactagattcagcctat

SEQ ID NO: 2054 - DNA, 20 bp, synthetic construct
  source 1..20: mol_type = other DNA
gccaatttttaatatcattt

SEQ ID NO: 2055 - DNA, 20 bp, synthetic construct
  source 1..20: mol_type = other DNA
ctgtagtacaaatctttcct

SEQ ID NO: 2056 - DNA, 20 bp, synthetic construct
  source 1..20: mol_type = other DNA
tgaagatatgacagaggcca

SEQ ID NO: 2057 - DNA, 20 bp, synthetic construct
  source 1..20: mol_type = other DNA
aacactttcagttgattaac

SEQ ID NO: 2058 - DNA, 20 bp, synthetic construct
  source 1..20: mol_type = other DNA
tgcacacattactctgagta

SEQ ID NO: 2059 - DNA, 20 bp, synthetic construct
  source 1..20: mol_type = other DNA
ttcaaatcacctacgatgac

SEQ ID NO: 2060 - DNA, 20 bp, synthetic construct
  source 1..20: mol_type = other DNA
acaactaattaacagaaaaa

SEQ ID NO: 2061 - DNA, 20 bp, synthetic construct
  source 1..20: mol_type = other DNA
ttctatcttcagtggtaata

SEQ ID NO: 2062 - DNA, 20 bp, synthetic construct
  source 1..20: mol_type = other DNA
ggaaaggaagtctttctatg

SEQ ID NO: 2063 - DNA, 20 bp, synthetic construct
  source 1..20: mol_type = other DNA
catcaagtaagaagagggcc

SEQ ID NO: 2064 - DNA, 20 bp, synthetic construct
  source 1..20: mol_type = other DNA
tcaatcagtacttgctgagc

SEQ ID NO: 2065 - DNA, 20 bp, synthetic construct
  source 1..20: mol_type = other DNA
cttagagtcatagggtgctt

SEQ ID NO: 2066 - DNA, 20 bp, synthetic construct
  source 1..20: mol_type = other DNA
cctatagatggcaagaggac

SEQ ID NO: 2067 - DNA, 20 bp, synthetic construct
  source 1..20: mol_type = other DNA
gaagcttaccaactgaatag

SEQ ID NO: 2068 - DNA, 20 bp, synthetic construct
  source 1..20: mol_type = other DNA
acactttcagttgattaact

SEQ ID NO: 2069 - DNA, 20 bp, synthetic construct
  source 1..20: mol_type = other DNA
accaacaatcaggatcctct

SEQ ID NO: 2070 - DNA, 20 bp, synthetic construct
  source 1..20: mol_type = other DNA
ccattagctagaaagaacga

SEQ ID NO: 2071 - DNA, 20 bp, synthetic construct
  source 1..20: mol_type = other DNA
atgactaaaagaggtacata

SEQ ID NO: 2072 - DNA, 20 bp, synthetic construct
  source 1..20: mol_type = other DNA
cagaggatgtttttgggcag

SEQ ID NO: 2073 - DNA, 20 bp, synthetic construct
  source 1..20: mol_type = other DNA
ccaatttttaatatcatttg

SEQ ID NO: 2074 - DNA, 20 bp, synthetic construct
  source 1..20: mol_type = other DNA
gcaattcaaatagcaagcca

SEQ ID NO: 2075 - DNA, 20 bp, synthetic construct
  source 1..20: mol_type = other DNA
gctgtgttccaagtactagt

SEQ ID NO: 2076 - DNA, 20 bp, synthetic construct
  source 1..20: mol_type = other DNA
caatcagtacttgctgagct

SEQ ID NO: 2077 - DNA, 20 bp, synthetic construct
  source 1..20: mol_type = other DNA
tttgtattcaagcatttctc

SEQ ID NO: 2078 - DNA, 20 bp, synthetic construct
  source 1..20: mol_type = other DNA
gatactagattcagcctata

SEQ ID NO: 2079 - DNA, 20 bp, synthetic construct
  source 1..20: mol_type = other DNA
aggtcacatagttcataagt

SEQ ID NO: 2080 - DNA, 20 bp, synthetic construct
  source 1..20: mol_type = other DNA
aagtggcagcaatcatgaag

SEQ ID NO: 2081 - DNA, 20 bp, synthetic construct
  source 1..20: mol_type = other DNA
tcttgtatactggtttgaaa

SEQ ID NO: 2082 - DNA, 20 bp, synthetic construct
  source 1..20: mol_type = other DNA
gagtcatagggtgcttgctg

SEQ ID NO: 2083 - DNA, 20 bp, synthetic construct
  source 1..20: mol_type = other DNA
ctatcagcaagacctgggac

SEQ ID NO: 2084 - DNA, 20 bp, synthetic construct
  source 1..20: mol_type = other DNA
gctagtttccttctattctc

SEQ ID NO: 2085 - DNA, 20 bp, synthetic construct
  source 1..20: mol_type = other DNA
ttgcagttgggaagtcatct

SEQ ID NO: 2086 - DNA, 20 bp, synthetic construct
  source 1..20: mol_type = other DNA
atgttaaacctaactcttaa

SEQ ID NO: 2087 - DNA, 20 bp, synthetic construct
  source 1..20: mol_type = other DNA
gcattcttgccattttgatg

SEQ ID NO: 2088 - DNA, 20 bp, synthetic construct
  source 1..20: mol_type = other DNA
cccaattttcccccacccct

SEQ ID NO: 2089 - DNA, 20 bp, synthetic construct
  source 1..20: mol_type = other DNA
gaagatatgacagaggccag

SEQ ID NO: 2090 - DNA, 20 bp, synthetic construct
  source 1..20: mol_type = other DNA
caccattagccaccagcaac

SEQ ID NO: 2091 - DNA, 20 bp, synthetic construct
  source 1..20: mol_type = other DNA
tagggcttcagtagtccatc

SEQ ID NO: 2092 - DNA, 20 bp, synthetic construct
  source 1..20: mol_type = other DNA
gatgcttgaaaattcaatta

SEQ ID NO: 2093 - DNA, 20 bp, synthetic construct
  source 1..20: mol_type = other DNA
aaacaaaacacaaggtacgg

SEQ ID NO: 2094 - DNA, 20 bp, synthetic construct
  source 1..20: mol_type = other DNA
aagcttaccaactgaatagc

SEQ ID NO: 2095 - DNA, 20 bp, synthetic construct
  source 1..20: mol_type = other DNA
tgcaattctatatcagaaat

SEQ ID NO: 2096 - DNA, 20 bp, synthetic construct
  source 1..20: mol_type = other DNA
aaaggaagtctttctatgca

SEQ ID NO: 2097 - DNA, 20 bp, synthetic construct
  source 1..20: mol_type = other DNA
aataccccatgaaatgagca

SEQ ID NO: 2098 - DNA, 20 bp, synthetic construct
  source 1..20: mol_type = other DNA
ccttaatcactgcaagactc

SEQ ID NO: 2099 - DNA, 20 bp, synthetic construct
  source 1..20: mol_type = other DNA
agttatctatcctgtgtcta

SEQ ID NO: 2100 - DNA, 20 bp, synthetic construct
  source 1..20: mol_type = other DNA
aaatctgggagctattcagg

SEQ ID NO: 2101 - DNA, 20 bp, synthetic construct
  source 1..20: mol_type = other DNA
tgtagtacaaatctttcctt

SEQ ID NO: 2102 - DNA, 20 bp, synthetic construct
  source 1..20: mol_type = other DNA
tcattctaaaacaaatcaag

SEQ ID NO: 2103 - DNA, 20 bp, synthetic construct
  source 1..20: mol_type = other DNA
tgatgtacacattccaattt

SEQ ID NO: 2104 - DNA, 20 bp, synthetic construct
  source 1..20: mol_type = other DNA
tcatggtagctgttatcaag

SEQ ID NO: 2105 - DNA, 20 bp, synthetic construct
  source 1..20: mol_type = other DNA
aggcaaagagttaagatggg

SEQ ID NO: 2106 - DNA, 20 bp, synthetic construct
  source 1..20: mol_type = other DNA
ttcttacaaaacattttccc

SEQ ID NO: 2107 - DNA, 20 bp, synthetic construct
  source 1..20: mol_type = other DNA
gctccatgatggaaattcag

SEQ ID NO: 2108 - DNA, 20 bp, synthetic construct
  source 1..20: mol_type = other DNA
ttttaacccaaagttaacaa

SEQ ID NO: 2109 - DNA, 20 bp, synthetic construct
  source 1..20: mol_type = other DNA
tagagcctcgctattagaga

SEQ ID NO: 2110 - DNA, 20 bp, synthetic construct
  source 1..20: mol_type = other DNA
gaaaagatccattgggctcc

SEQ ID NO: 2111 - DNA, 20 bp, synthetic construct
  source 1..20: mol_type = other DNA
gtaaagctcttacatctcct

SEQ ID NO: 2112 - DNA, 20 bp, synthetic construct
  source 1..20: mol_type = other DNA
tcaaatcacctacgatgact

SEQ ID NO: 2113 - DNA, 20 bp, synthetic construct
  source 1..20: mol_type = other DNA
ccccaaataagtaataaaca

SEQ ID NO: 2114 - DNA, 20 bp, synthetic construct
  source 1..20: mol_type = other DNA
ttgttgaacagcagtgcact

SEQ ID NO: 2115 - DNA, 20 bp, synthetic construct
  source 1..20: mol_type = other DNA
cttgcagacaatgttttgct

SEQ ID NO: 2116 - DNA, 20 bp, synthetic construct
  source 1..20: mol_type = other DNA
ctagcaggaaccagctatga

SEQ ID NO: 2117 - DNA, 20 bp, synthetic construct
  source 1..20: mol_type = other DNA
gacattagataggattcctg

SEQ ID NO: 2118 - DNA, 20 bp, synthetic construct
  source 1..20: mol_type = other DNA
tttcctagtttaaaaaacag

SEQ ID NO: 2119 - DNA, 20 bp, synthetic construct
  source 1..20: mol_type = other DNA
caactaattaacagaaaaaa

SEQ ID NO: 2120 - DNA, 20 bp, synthetic construct
  source 1..20: mol_type = other DNA
gatgctgacaacaccctgtt

SEQ ID NO: 2121 - DNA, 20 bp, synthetic construct
  source 1..20: mol_type = other DNA
atctatatcaggagaaaata

SEQ ID NO: 2122 - DNA, 20 bp, synthetic construct
  source 1..20: mol_type = other DNA
cttggcaacattacatgttc

SEQ ID NO: 2123 - DNA, 20 bp, synthetic construct
  source 1..20: mol_type = other DNA
atcaagtaagaagagggcca

SEQ ID NO: 2124 - DNA, 20 bp, synthetic construct
  source 1..20: mol_type = other DNA
ccctttgagaagaaattact

SEQ ID NO: 2125 - DNA, 20 bp, synthetic construct
  source 1..20: mol_type = other DNA
agataacattgctaagtaaa

SEQ ID NO: 2126 - DNA, 20 bp, synthetic construct
  source 1..20: mol_type = other DNA
atcaaagaattattctccag

SEQ ID NO: 2127 - DNA, 20 bp, synthetic construct
  source 1..20: mol_type = other DNA
attttgtacaccaaagagaa

SEQ ID NO: 2128 - DNA, 20 bp, synthetic construct
  source 1..20: mol_type = other DNA
aacaattcagtaatatcagc

SEQ ID NO: 2129 - DNA, 20 bp, synthetic construct
  source 1..20: mol_type = other DNA
tacctgagcatctttccttc

SEQ ID NO: 2130 - DNA, 20 bp, synthetic construct
  source 1..20: mol_type = other DNA
catgctttcaccttatcttt

SEQ ID NO: 2131 - DNA, 20 bp, synthetic construct
  source 1..20: mol_type = other DNA
ctatagatggcaagaggacc

SEQ ID NO: 2132 - DNA, 20 bp, synthetic construct
  source 1..20: mol_type = other DNA
atcatgaatacagctttctg

SEQ ID NO: 2133 - DNA, 20 bp, synthetic construct
  source 1..20: mol_type = other DNA
agaaaatcccaatagattca

SEQ ID NO: 2134 - DNA, 20 bp, synthetic construct
  source 1..20: mol_type = other DNA
tctatcttcagtggtaatag

SEQ ID NO: 2135 - DNA, 20 bp, synthetic construct
  source 1..20: mol_type = other DNA
actaacaattcaggcagcca

SEQ ID NO: 2136 - DNA, 20 bp, synthetic construct
  source 1..20: mol_type = other DNA
gataagtttctaaaagttta

SEQ ID NO: 2137 - DNA, 20 bp, synthetic construct
  source 1..20: mol_type = other DNA
tgtgaattcagtacaagaat

SEQ ID NO: 2138 - DNA, 20 bp, synthetic construct
  source 1..20: mol_type = other DNA
gtttctgcaaaggcagaata

SEQ ID NO: 2139 - DNA, 20 bp, synthetic construct
  source 1..20: mol_type = other DNA
gaacaacacaactctttaca

SEQ ID NO: 2140 - DNA, 20 bp, synthetic construct
  source 1..20: mol_type = other DNA
cacacattactctgagtaga

SEQ ID NO: 2141 - DNA, 20 bp, synthetic construct
  source 1..20: mol_type = other DNA
tgacccccttctcccagctg

SEQ ID NO: 2142 - DNA, 20 bp, synthetic construct
  source 1..20: mol_type = other DNA
tctctgagtatctttgtcct

SEQ ID NO: 2143 - DNA, 20 bp, synthetic construct
  source 1..20: mol_type = other DNA
tactcaaattgagattcaaa

SEQ ID NO: 2144 - DNA, 20 bp, synthetic construct
  source 1..20: mol_type = other DNA
ttgcaattctatatcagaaa

SEQ ID NO: 2145 - DNA, 20 bp, synthetic construct
  source 1..20: mol_type = other DNA
catcagatgttcatctcttc

SEQ ID NO: 2146 - DNA, 20 bp, synthetic construct
  source 1..20: mol_type = other DNA
attctccagacatttctgat

SEQ ID NO: 2147 - DNA, 20 bp, synthetic construct
  source 1..20: mol_type = other DNA
tattctccagacatttctga

SEQ ID NO: 2148 - DNA, 20 bp, synthetic construct
  source 1..20: mol_type = other DNA
tatgtgatctatatcaggag

SEQ ID NO: 2149 - DNA, 20 bp, synthetic construct
  source 1..20: mol_type = other DNA
agagggccatctcaggttac

SEQ ID NO: 2150 - DNA, 20 bp, synthetic construct
  source 1..20: mol_type = other DNA
gtacaaatctttccttcaat

SEQ ID NO: 2151 - DNA, 20 bp, synthetic construct
  source 1..20: mol_type = other DNA
agatgttcatctcttcacaa

SEQ ID NO: 2152 - DNA, 20 bp, synthetic construct
  source 1..20: mol_type = other DNA
tcagatgttcatctcttcac

SEQ ID NO: 2153 - DNA, 20 bp, synthetic construct
  source 1..20: mol_type = other DNA
atcagatgttcatctcttca

SEQ ID NO: 2154 - DNA, 20 bp, synthetic construct
  source 1..20: mol_type = other DNA
agcctccattcctttgtgac

SEQ ID NO: 2155 - DNA, 20 bp, synthetic construct
  source 1..20: mol_type = other DNA
gagcctccattcctttgtga

SEQ ID NO: 2156 - DNA, 20 bp, synthetic construct
  source 1..20: mol_type = other DNA
  modified_base 1: mod_base = OTHER; note = 2'-MOE 5-methylcytidine 3'-phosphorothioate
  modified_base 2..3: mod_base = OTHER; note = 2'-MOE 5-methylcytidine 3'-phosphodiester
  modified_base 4..5: mod_base = OTHER; note = 2'-MOE adenosine 3'-phosphodiester
  modified_base 6: mod_base = OTHER; note = 2'-deoxythymidine 3'-phosphorothioate
  modified_base 7: mod_base = OTHER; note = 2'-deoxyadenosine 3'-phosphorothioate
  modified_base 8: mod_base = OTHER; note = 2'-deoxyguanosine 3'-phosphorothioate
  modified_base 9: mod_base = OTHER; note = 2'-deoxyadenosine 3'-phosphorothioate
  modified_base 10..11: mod_base = OTHER; note = 2'-deoxythymidine 3'-phosphorothioate
  modified_base 12: mod_base = OTHER; note = 5-methyl-2'-deoxycytidine 3'-phosphorothioate
  modified_base 13..14: mod_base = OTHER; note = 2'-deoxyadenosine 3'-phosphorothioate
  modified_base 15: mod_base = OTHER; note = 5-methyl-2'-deoxycytidine 3'-phosphorothioate
  modified_base 16: mod_base = OTHER; note = 2'-MOE thymidine 3'-phosphodiester
  modified_base 17: mod_base = OTHER; note = 2'-MOE adenosine 3'-phosphodiester
  modified_base 18: mod_base = OTHER; note = 2'-MOE guanosine 3'-phosphorothioate
  modified_base 19: mod_base = OTHER; note = 2'-MOE 5-methylcytidine 3'-phosphorothioate
  modified_base 20: mod_base = OTHER; note = 2'-MOE 5-methylcytidine
cccaatagattcaactagcc

SEQ ID NO: 2157 - DNA, 20 bp, synthetic construct
  source 1..20: mol_type = other DNA
  modified_base 1: mod_base = OTHER; note = 2'-MOE adenosine 3'-phosphorothioate
  modified_base 2: mod_base = OTHER; note = 2'-MOE 5-methylcytidine 3'-phosphodiester
  modified_base 3: mod_base = OTHER; note = 2'-MOE adenosine 3'-phosphodiester
  modified_base 4: mod_base = OTHER; note = 2'-MOE 5-methylcytidine 3'-phosphodiester
  modified_base 5: mod_base = OTHER; note = 2'-MOE adenosine 3'-phosphodiester
  modified_base 6: mod_base = OTHER; note = 2'-deoxyadenosine 3'-phosphorothioate
  modified_base 7: mod_base = OTHER; note = 5-methyl-2'-deoxycytidine 3'-phosphorothioate
  modified_base 8: mod_base = OTHER; note = 2'-deoxythymidine 3'-phosphorothioate
  modified_base 9: mod_base = OTHER; note = 5-methyl-2'-deoxycytidine 3'-phosphorothioate
  modified_base 10..12: mod_base = OTHER; note = 2'-deoxythymidine 3'-phosphorothioate
  modified_base 13: mod_base = OTHER; note = 2'-deoxyadenosine 3'-phosphorothioate
  modified_base 14: mod_base = OTHER; note = 5-methyl-2'-deoxycytidine 3'-phosphorothioate
  modified_base 15: mod_base = OTHER; note = 2'-deoxyadenosine 3'-phosphorothioate
  modified_base 16: mod_base = OTHER; note = 2'-MOE adenosine 3'-phosphodiester
  modified_base 17: mod_base = OTHER; note = 2'-MOE 5-methylcytidine 3'-phosphodiester
  modified_base 18..19: mod_base = OTHER; note = 2'-MOE adenosine 3'-phosphorothioate
  modified_base 20: mod_base = OTHER; note = 2'-MOE adenosine
acacaactctttacaacaaa

SEQ ID NO: 2158 - DNA, 20 bp, synthetic construct
  source 1..20: mol_type = other DNA
  modified_base 1: mod_base = OTHER; note = 2'-MOE thymidine 3'-phosphorothioate
  modified_base 2: mod_base = OTHER; note = 2'-MOE 5-methylcytidine 3'-phosphodiester
  modified_base 3: mod_base = OTHER; note = 2'-MOE thymidine 3'-phosphodiester
  modified_base 4..5: mod_base = OTHER; note = 2'-MOE 5-methylcytidine 3'-phosphodiester
  modified_base 6: mod_base = OTHER; note = 2'-deoxyadenosine 3'-phosphorothioate
  modified_base 7: mod_base = OTHER; note = 2'-deoxyguanosine 3'-phosphorothioate
  modified_base 8: mod_base = OTHER; note = 2'-deoxyadenosine 3'-phosphorothioate
  modified_base 9: mod_base = OTHER; note = 5-methyl-2'-deoxycytidine 3'-phosphorothioate
  modified_base 10: mod_base = OTHER; note = 2'-deoxyadenosine 3'-phosphorothioate
  modified_base 11..13: mod_base = OTHER; note = 2'-deoxythymidine 3'-phosphorothioate
  modified_base 14: mod_base = OTHER; note = 5-methyl-2'-deoxycytidine 3'-phosphorothioate
  modified_base 15: mod_base = OTHER; note = 2'-deoxythymidine 3'-phosphorothioate
  modified_base 16: mod_base = OTHER; note = 2'-MOE guanosine 3'-phosphodiester
  modified_base 17: mod_base = OTHER; note = 2'-MOE adenosine 3'-phosphodiester
  modified_base 18: mod_base = OTHER; note = 2'-MOE thymidine 3'-phosphorothioate
  modified_base 19: mod_base = OTHER; note = 2'-MOE guanosine 3'-phosphorothioate
  modified_base 20: mod_base = OTHER; note = 2'-MOE 5-methylcytidine
tctccagacatttctgatgc

SEQ ID NO: 2159 - DNA, 20 bp, synthetic construct
  source 1..20: mol_type = other DNA
  modified_base 1: mod_base = OTHER; note = 2'-MOE guanosine 3'-phosphorothioate
  modified_base 2: mod_base = OTHER; note = 2'-MOE thymidine 3'-phosphodiester
  modified_base 3: mod_base = OTHER; note = 2'-MOE guanosine 3'-phosphodiester
  modified_base 4: mod_base = OTHER; note = 2'-MOE thymidine 3'-phosphodiester
  modified_base 5: mod_base = OTHER; note = 2'-MOE guanosine 3'-phosphodiester
  modified_base 6..7: mod_base = OTHER; note = 2'-deoxythymidine 3'-phosphorothioate
  modified_base 8..11: mod_base = OTHER; note = 2'-deoxyadenosine 3'-phosphorothioate
  modified_base 12..13: mod_base = OTHER; note = 2'-deoxythymidine 3'-phosphorothioate
  modified_base 14: mod_base = OTHER; note = 2'-deoxyguanosine 3'-phosphorothioate
  modified_base 15: mod_base = OTHER; note = 5-methyl-2'-deoxycytidine 3'-phosphorothioate
  modified_base 16..17: mod_base = OTHER; note = 2'-MOE adenosine 3'-phosphodiester
  modified_base 18..19: mod_base = OTHER; note = 2'-MOE thymidine 3'-phosphorothioate
  modified_base 20: mod_base = OTHER; note = 2'-MOE 5-methylcytidine
gtgtgttaaaattgcaattc

SEQ ID NO: 2160 - DNA, 20 bp, synthetic construct
  source 1..20: mol_type = other DNA
  modified_base 1: mod_base = OTHER; note = 2'-MOE adenosine 3'-phosphorothioate
  modified_base 2..3: mod_base = OTHER; note = 2'-MOE thymidine 3'-phosphodiester
  modified_base 4: mod_base = OTHER; note = 2'-MOE guanosine 3'-phosphodiester
  modified_base 5: mod_base = OTHER; note = 2'-MOE 5-methylcytidine 3'-phosphodiester
  modified_base 6..7: mod_base = OTHER; note = 2'-deoxyadenosine 3'-phosphorothioate
  modified_base 8..9: mod_base = OTHER; note = 2'-deoxythymidine 3'-phosphorothioate
  modified_base 10: mod_base = OTHER; note = 5-methyl-2'-deoxycytidine 3'-phosphorothioate
  modified_base 11: mod_base = OTHER; note = 2'-deoxythymidine 3'-phosphorothioate
  modified_base 12: mod_base = OTHER; note = 2'-deoxyadenosine 3'-phosphorothioate
  modified_base 13: mod_base = OTHER; note = 2'-deoxythymidine 3'-phosphorothioate
  modified_base 14: mod_base = OTHER; note = 2'-deoxyadenosine 3'-phosphorothioate
  modified_base 15: mod_base = OTHER; note = 2'-deoxythymidine 3'-phosphorothioate
  modified_base 16: mod_base = OTHER; note = 2'-MOE 5-methylcytidine 3'-phosphodiester
  modified_base 17: mod_base = OTHER; note = 2'-MOE adenosine 3'-phosphodiester
  modified_base 18: mod_base = OTHER; note = 2'-MOE guanosine 3'-phosphorothioate
  modified_base 19: mod_base = OTHER; note = 2'-MOE adenosine 3'-phosphorothioate
  modified_base 20: mod_base = OTHER; note = 2'-MOE adenosine
attgcaattctatatcagaa

SEQ ID NO: 2161 - DNA, 20 bp, synthetic construct
  source 1..20: mol_type = other DNA
  modified_base 1: mod_base = OTHER; note = 2'-MOE adenosine 3'-phosphorothioate
  modified_base 2: mod_base = OTHER; note = 2'-MOE thymidine 3'-phosphodiester
  modified_base 3: mod_base = OTHER; note = 2'-MOE guanosine 3'-phosphodiester
  modified_base 4: mod_base = OTHER; note = 2'-MOE thymidine 3'-phosphodiester
  modified_base 5: mod_base = OTHER; note = 2'-MOE guanosine 3'-phosphodiester
  modified_base 6: mod_base = OTHER; note = 2'-deoxyadenosine 3'-phosphorothioate
  modified_base 7: mod_base = OTHER; note = 2'-deoxythymidine 3'-phosphorothioate
  modified_base 8: mod_base = OTHER; note = 5-methyl-2'-deoxycytidine 3'-phosphorothioate
  modified_base 9: mod_base = OTHER; note = 2'-deoxythymidine 3'-phosphorothioate
  modified_base 10: mod_base = OTHER; note = 2'-deoxyadenosine 3'-phosphorothioate
  modified_base 11: mod_base = OTHER; note = 2'-deoxythymidine 3'-phosphorothioate
  modified_base 12: mod_base = OTHER; note = 2'-deoxyadenosine 3'-phosphorothioate
  modified_base 13: mod_base = OTHER; note = 2'-deoxythymidine 3'-phosphorothioate
  modified_base 14: mod_base = OTHER; note = 5-methyl-2'-deoxycytidine 3'-phosphorothioate
  modified_base 15: mod_base = OTHER; note = 2'-deoxyadenosine 3'-phosphorothioate
  modified_base 16..17: mod_base = OTHER; note = 2'-MOE guanosine 3'-phosphodiester
  modified_base 18: mod_base = OTHER; note = 2'-MOE adenosine 3'-phosphorothioate
  modified_base 19: mod_base = OTHER; note = 2'-MOE guanosine 3'-phosphorothioate
  modified_base 20: mod_base = OTHER; note = 2'-MOE adenosine
atgtgatctatatcaggaga

SEQ ID NO: 2162 - DNA, 20 bp, synthetic construct
  source 1..20: mol_type = other DNA
  modified_base 1: mod_base = OTHER; note = 2'-MOE adenosine 3'-phosphorothioate
  modified_base 2..3: mod_base = OTHER; note = 2'-MOE 5-methylcytidine 3'-phosphodiester
  modified_base 4: mod_base = OTHER; note = 2'-MOE adenosine 3'-phosphodiester
  modified_base 5: mod_base = OTHER; note = 2'-MOE guanosine 3'-phosphodiester
  modified_base 6: mod_base = OTHER; note = 2'-deoxyadenosine 3'-phosphorothioate
  modified_base 7..9: mod_base = OTHER; note = 2'-deoxyguanosine 3'-phosphorothioate
  modified_base 10..11: mod_base = OTHER; note = 5-methyl-2'-deoxycytidine 3'-phosphorothioate
  modified_base 12: mod_base = OTHER; note = 2'-deoxyadenosine 3'-phosphorothioate
  modified_base 13: mod_base = OTHER; note = 2'-deoxythymidine 3'-phosphorothioate
  modified_base 14: mod_base = OTHER; note = 5-methyl-2'-deoxycytidine 3'-phosphorothioate
  modified_base 15: mod_base = OTHER; note = 2'-deoxythymidine 3'-phosphorothioate
  modified_base 16: mod_base = OTHER; note = 2'-MOE 5-methylcytidine 3'-phosphodiester
  modified_base 17: mod_base = OTHER; note = 2'-MOE adenosine 3'-phosphodiester
  modified_base 18..19: mod_base = OTHER; note = 2'-MOE guanosine 3'-phosphorothioate
  modified_base 20: mod_base = OTHER; note = 2'-MOE thymidine
accagagggccatctcaggt

SEQ ID NO: 2163 - DNA, 20 bp, synthetic construct
  source 1..20: mol_type = other DNA
  modified_base 1: mod_base = OTHER; note = 2'-MOE thymidine 3'-phosphorothioate
  modified_base 2: mod_base = OTHER; note = 2'-MOE guanosine 3'-phosphodiester
  modified_base 5: mod_base = OTHER; note = 2'-MOE guanosine 3'-phosphodiester
  modified_base 3: mod_base = OTHER; note = 2'-MOE thymidine 3'-phosphodiester
  modified_base 4: mod_base = OTHER; note = 2'-MOE adenosine 3'-phosphodiester
  modified_base 6: mod_base = OTHER; note = 2'-deoxythymidine 3'-phosphorothioate
  modified_base 7: mod_base = OTHER; note = 2'-deoxyadenosine 3'-phosphorothioate
  modified_base 8: mod_base = OTHER; note = 5-methyl-2'-deoxycytidine 3'-phosphorothioate
  modified_base 9..11: mod_base = OTHER; note = 2'-deoxyadenosine 3'-phosphorothioate
  modified_base 12: mod_base = OTHER; note = 2'-deoxythymidine 3'-phosphorothioate
  modified_base 13: mod_base = OTHER; note = 5-methyl-2'-deoxycytidine 3'-phosphorothioate
  modified_base 14..15: mod_base = OTHER; note = 2'-deoxythymidine 3'-phosphorothioate
  modified_base 16: mod_base = OTHER; note = 2'-MOE thymidine 3'-phosphodiester
  modified_base 17: mod_base = OTHER; note = 2'-MOE 5-methylcytidine 3'-phosphodiester
  modified_base 18: mod_base = OTHER; note = 2'-MOE 5-methylcytidine 3'-phosphorothioate
  modified_base 19: mod_base = OTHER; note = 2'-MOE thymidine 3'-phosphorothioate
  modified_base 20: mod_base = OTHER; note = 2'-MOE thymidine
tgtagtacaaatctttcctt

SEQ ID NO: 2164 - DNA, 20 bp, synthetic construct
  source 1..20: mol_type = other DNA
  modified_base 1: mod_base = OTHER; note = 2'-MOE guanosine 3'-phosphorothioate
  modified_base 2: mod_base = OTHER; note = 2'-MOE 5-methylcytidine 3'-phosphodiester
  modified_base 3: mod_base = OTHER; note = 2'-MOE adenosine 3'-phosphodiester
  modified_base 4: mod_base = OTHER; note = 2'-MOE thymidine 3'-phosphodiester
  modified_base 5: mod_base = OTHER; note = 2'-MOE 5-methylcytidine 3'-phosphodiester
  modified_base 6: mod_base = OTHER; note = 2'-deoxyadenosine 3'-phosphorothioate
  modified_base 7: mod_base = OTHER; note = 2'-deoxyguanosine 3'-phosphorothioate
  modified_base 8: mod_base = OTHER; note = 2'-deoxyadenosine 3'-phosphorothioate
  modified_base 9: mod_base = OTHER; note = 2'-deoxythymidine 3'-phosphorothioate
  modified_base 10: mod_base = OTHER; note = 2'-deoxyguanosine 3'-phosphorothioate
  modified_base 11..12: mod_base = OTHER; note = 2'-deoxythymidine 3'-phosphorothioate
  modified_base 13: mod_base = OTHER; note = 5-methyl-2'-deoxycytidine 3'-phosphorothioate
  modified_base 14: mod_base = OTHER; note = 2'-deoxyadenosine 3'-phosphorothioate
  modified_base 15: mod_base = OTHER; note = 2'-deoxythymidine 3'-phosphorothioate
  modified_base 16: mod_base = OTHER; note = 2'-MOE 5-methylcytidine 3'-phosphodiester
  modified_base 17: mod_base = OTHER; note = 2'-MOE thymidine 3'-phosphodiester
  modified_base 18: mod_base = OTHER; note = 2'-MOE 5-methylcytidine 3'-phosphorothioate
  modified_base 19: mod_base = OTHER; note = 2'-MOE thymidine 3'-phosphorothioate
  modified_base 20: mod_base = OTHER; note = 2'-MOE thymidine
gcatcagatgttcatctctt

SEQ ID NO: 2165 - DNA, 20 bp, synthetic construct
  source 1..20: mol_type = other DNA
  modified_base 1: mod_base = OTHER; note = 2'-MOE 5-methylcytidine 3'-phosphorothioate
  modified_base 2: mod_base = OTHER; note = 2'-MOE 5-methylcytidine 3'-phosphodiester
  modified_base 4..5: mod_base = OTHER; note = 2'-MOE 5-methylcytidine 3'-phosphodiester
  modified_base 3: mod_base = OTHER; note = 2'-MOE thymidine 3'-phosphodiester
  modified_base 6: mod_base = OTHER; note = 2'-deoxyadenosine 3'-phosphorothioate
  modified_base 7..8: mod_base = OTHER; note = 2'-deoxythymidine 3'-phosphorothioate
  modified_base 9..10: mod_base = OTHER; note = 5-methyl-2'-deoxycytidine 3'-phosphorothioate
  modified_base 11..13: mod_base = OTHER; note = 2'-deoxythymidine 3'-phosphorothioate
  modified_base 15: mod_base = OTHER; note = 2'-deoxythymidine 3'-phosphorothioate
  modified_base 14: mod_base = OTHER; note = 2'-deoxyguanosine 3'-phosphorothioate
  modified_base 16: mod_base = OTHER; note = 2'-MOE guanosine 3'-phosphodiester
  modified_base 17: mod_base = OTHER; note = 2'-MOE adenosine 3'-phosphodiester
  modified_base 18: mod_base = OTHER; note = 2'-MOE 5-methylcytidine 3'-phosphorothioate
  modified_base 19: mod_base = OTHER; note = 2'-MOE thymidine 3'-phosphorothioate
  modified_base 20: mod_base = OTHER; note = 2'-MOE thymidine
cctccattcctttgtgactt

SEQ ID NO: 2166 - DNA, 20 bp, synthetic construct
  source 1..20: mol_type = other DNA
  modified_base 1: mod_base = OTHER; note = 2'-MOE adenosine 3'-phosphorothioate
  modified_base 2: mod_base = OTHER; note = 2'-MOE 5-methylcytidine 3'-phosphodiester
  modified_base 3..5: mod_base = OTHER; note = 2'-MOE adenosine 3'-phosphodiester
  modified_base 6: mod_base = OTHER; note = 2'-MOE thymidine 3'-phosphodiester
  modified_base 7: mod_base = OTHER; note = 5-methyl-2'-deoxycytidine 3'-phosphorothioate
  modified_base 8..10: mod_base = OTHER; note = 2'-deoxythymidine 3'-phosphorothioate
  modified_base 11..12: mod_base = OTHER; note = 5-methyl-2'-deoxycytidine 3'-phosphorothioate
  modified_base 13..14: mod_base = OTHER; note = 2'-deoxythymidine 3'-phosphorothioate
  modified_base 15: mod_base = OTHER; note = 5-methyl-2'-deoxycytidine 3'-phosphorothioate
  modified_base 16: mod_base = OTHER; note = 2'-deoxyadenosine 3'-phosphorothioate
  modified_base 17: mod_base = OTHER; note = 2'-MOE adenosine 3'-phosphodiester
  modified_base 18..19: mod_base = OTHER; note = 2'-MOE thymidine 3'-phosphorothioate
  modified_base 20: mod_base = OTHER; note = 2'-MOE adenosine
acaaatctttccttcaatta

SEQ ID NO: 2167 - DNA, 20 bp, synthetic construct
  source 1..20: mol_type = other DNA
  modified_base 1: mod_base = OTHER; note = 2'-MOE 5-methylcytidine 3'-phosphorothioate
  modified_base 2: mod_base = OTHER; note = 2'-MOE adenosine 3'-phosphodiester
  modified_base 4: mod_base = OTHER; note = 2'-MOE adenosine 3'-phosphodiester
  modified_base 3: mod_base = OTHER; note = 2'-MOE guanosine 3'-phosphodiester
  modified_base 6: mod_base = OTHER; note = 2'-MOE guanosine 3'-phosphodiester
  modified_base 5: mod_base = OTHER; note = 2'-MOE thymidine 3'-phosphodiester
  modified_base 7..8: mod_base = OTHER; note = 2'-deoxythymidine 3'-phosphorothioate
  modified_base 9: mod_base = OTHER; note = 5-methyl-2'-deoxycytidine 3'-phosphorothioate
  modified_base 10: mod_base = OTHER; note = 2'-deoxyadenosine 3'-phosphorothioate
  modified_base 11: mod_base = OTHER; note = 2'-deoxythymidine 3'-phosphorothioate
  modified_base 12: mod_base = OTHER; note = 5-methyl-2'-deoxycytidine 3'-phosphorothioate
  modified_base 13: mod_base = OTHER; note = 2'-deoxythymidine 3'-phosphorothioate
  modified_base 14: mod_base = OTHER; note = 5-methyl-2'-deoxycytidine 3'-phosphorothioate
  modified_base 15..16: mod_base = OTHER; note = 2'-deoxythymidine 3'-phosphorothioate
  modified_base 17: mod_base = OTHER; note = 2'-MOE 5-methylcytidine 3'-phosphodiester
  modified_base 18: mod_base = OTHER; note = 2'-MOE adenosine 3'-phosphorothioate
  modified_base 19: mod_base = OTHER; note = 2'-MOE 5-methylcytidine 3'-phosphorothioate
  modified_base 20: mod_base = OTHER; note = 2'-MOE adenosine
cagatgttcatctcttcaca

SEQ ID NO: 2168 - DNA, 20 bp, synthetic construct
  source 1..20: mol_type = other DNA
  modified_base 1: mod_base = OTHER; note = 2'-MOE 5-methylcytidine 3'-phosphorothioate
  modified_base 2: mod_base = OTHER; note = 2'-MOE adenosine 3'-phosphodiester
  modified_base 3: mod_base = OTHER; note = 2'-MOE thymidine 3'-phosphodiester
  modified_base 4: mod_base = OTHER; note = 2'-MOE 5-methylcytidine 3'-phosphodiester
  modified_base 5: mod_base = OTHER; note = 2'-MOE adenosine 3'-phosphodiester
  modified_base 6: mod_base = OTHER; note = 2'-MOE guanosine 3'-phosphodiester
  modified_base 7: mod_base = OTHER; note = 2'-deoxyadenosine 3'-phosphorothioate
  modified_base 8: mod_base = OTHER; note = 2'-deoxythymidine 3'-phosphorothioate
  modified_base 9: mod_base = OTHER; note = 2'-deoxyguanosine 3'-phosphorothioate
  modified_base 10..11: mod_base = OTHER; note = 2'-deoxythymidine 3'-phosphorothioate
  modified_base 12: mod_base = OTHER; note = 5-methyl-2'-deoxycytidine 3'-phosphorothioate
  modified_base 13: mod_base = OTHER; note = 2'-deoxyadenosine 3'-phosphorothioate
  modified_base 14: mod_base = OTHER; note = 2'-deoxythymidine 3'-phosphorothioate
  modified_base 15: mod_base = OTHER; note = 5-methyl-2'-deoxycytidine 3'-phosphorothioate
  modified_base 16: mod_base = OTHER; note = 2'-deoxythymidine 3'-phosphorothioate
  modified_base 17: mod_base = OTHER; note = 2'-MOE 5-methylcytidine 3'-phosphodiester
  modified_base 18..19: mod_base = OTHER; note = 2'-MOE thymidine 3'-phosphorothioate
  modified_base 20: mod_base = OTHER; note = 2'-MOE 5-methylcytidine
catcagatgttcatctcttc

The invention claimed is:
1. A modified oligonucleotide according to the following chemical structure:
(SEQ ID NO: 2163)
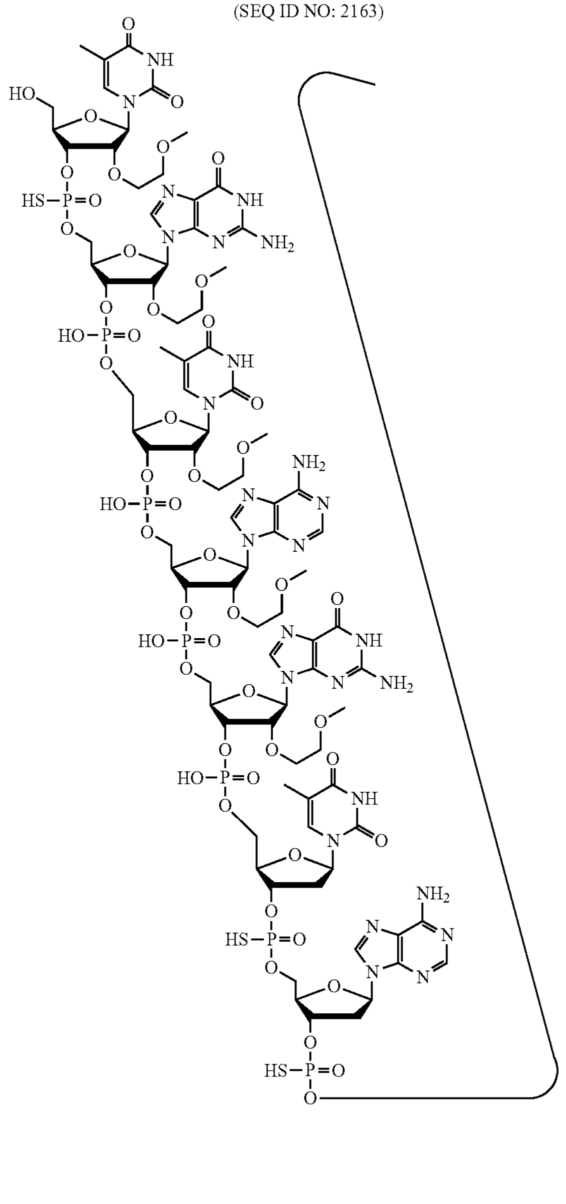
-continued
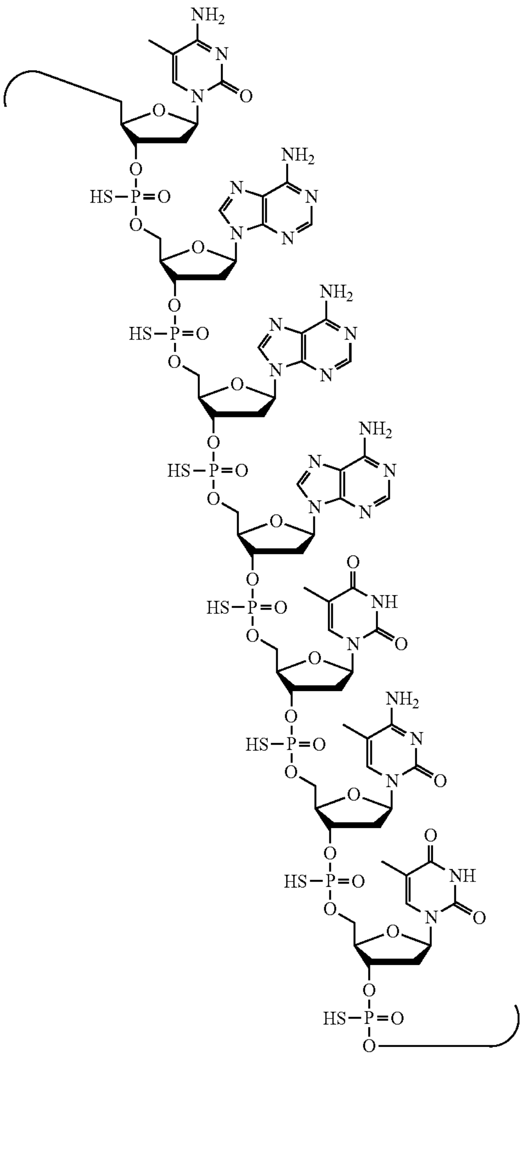

-continued

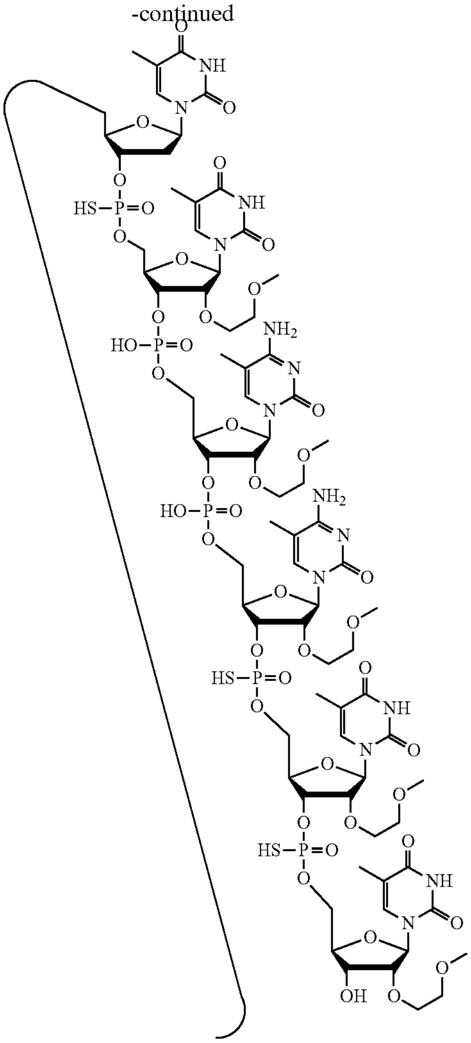

or a salt thereof.

2. The modified oligonucleotide of claim 1, which is the sodium salt or the potassium salt.

3. A population of modified oligonucleotides of claim 1, wherein all of the phosphorothioate internucleoside linkages of the modified oligonucleotide are stereorandom.

4. A population of modified oligonucleotides of claim 2, wherein all of the phosphorothioate internucleoside linkages of the modified oligonucleotide are stereorandom.

5. A pharmaceutical composition comprising the modified oligonucleotide of claim 1, and a pharmaceutically acceptable diluent.

6. A pharmaceutical composition comprising the population of modified oligonucleotides of claim 3, and a pharmaceutically acceptable diluent.

7. A pharmaceutical composition comprising the population of modified oligonucleotides of claim 4, and a pharmaceutically acceptable diluent.

8. A pharmaceutical composition comprising the modified oligonucleotide of claim 2, and a pharmaceutically acceptable diluent.

9. The pharmaceutical composition of claim 5, wherein the pharmaceutically acceptable diluent is artificial cerebrospinal fluid or phosphate-buffered saline (PBS).

10. The pharmaceutical composition of claim 6, wherein the pharmaceutically acceptable diluent is artificial cerebrospinal fluid or phosphate-buffered saline (PBS).

11. The pharmaceutical composition of claim 7, wherein the pharmaceutically acceptable diluent is artificial cerebrospinal fluid or phosphate-buffered saline (PBS).

12. The pharmaceutical composition of claim 8, wherein the pharmaceutically acceptable diluent is artificial cerebrospinal fluid or phosphate-buffered saline (PBS).

13. The pharmaceutical composition of claim 9, wherein the pharmaceutical composition consists essentially of the modified oligonucleotide and artificial cerebrospinal fluid.

14. The pharmaceutical composition of claim 12, wherein the pharmaceutical composition consists essentially of the modified oligonucleotide and artificial cerebrospinal fluid.

15. The pharmaceutical composition of claim 9, wherein the pharmaceutical composition consists essentially of the modified oligonucleotide and PBS.

16. The pharmaceutical composition of claim 12, wherein the pharmaceutical composition consists essentially of the modified oligonucleotide and PBS.

17. A modified oligonucleotide according to the following chemical structure:

(SEQ ID NO: 2163)

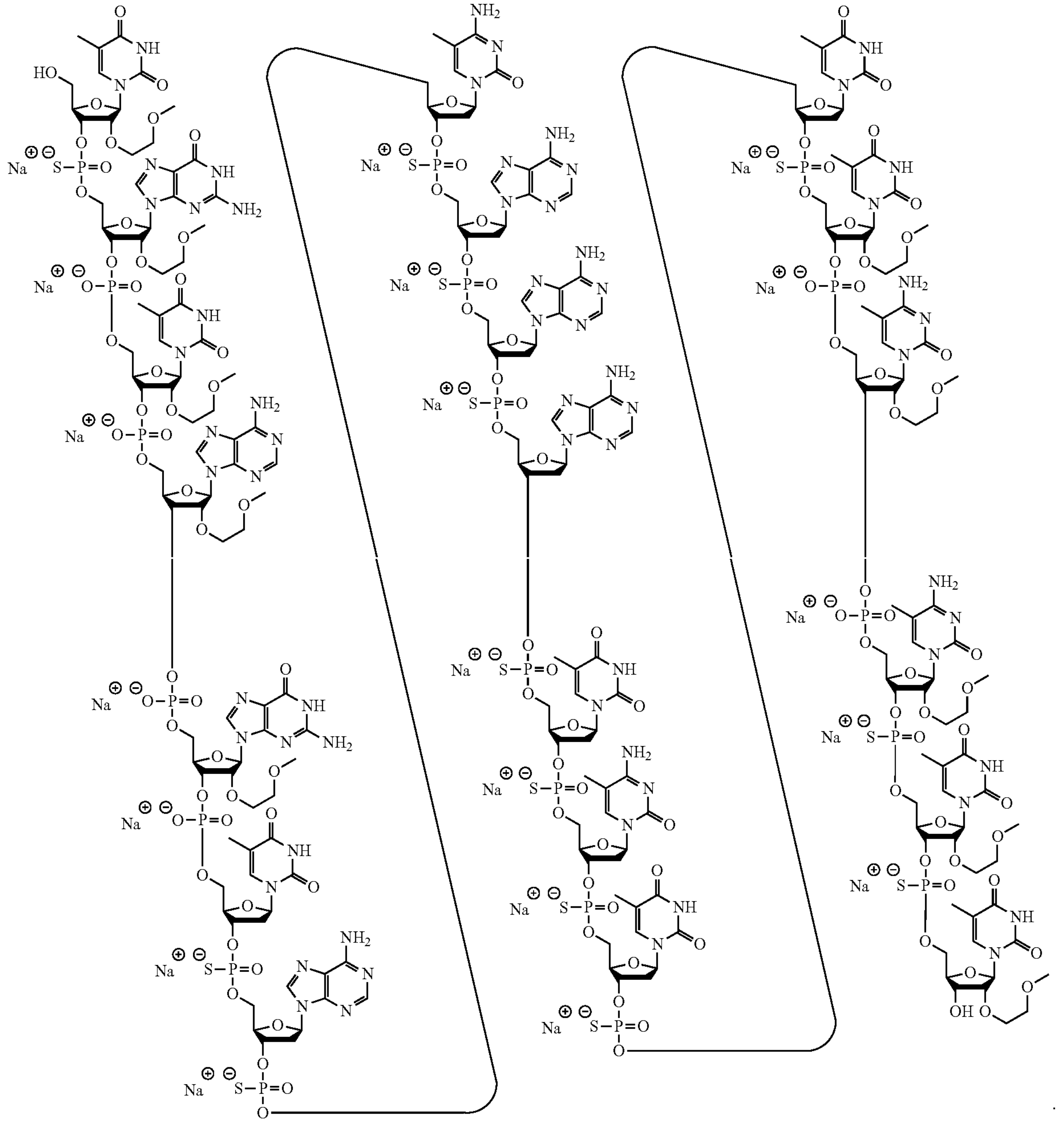

18. A population of modified oligonucleotides of claim 17, wherein all of the phosphorothioate internucleoside linkages of the modified oligonucleotide are stereorandom.

19. A pharmaceutical composition comprising the modified oligonucleotide of claim 17, and a pharmaceutically acceptable diluent.

20. A pharmaceutical composition comprising the population of modified oligonucleotides of claim 18, and a pharmaceutically acceptable diluent.

21. The pharmaceutical composition of claim 19, wherein the pharmaceutically acceptable diluent is artificial cerebrospinal fluid or phosphate-buffered saline (PBS).

22. The pharmaceutical composition of claim 20, wherein the pharmaceutically acceptable diluent is artificial cerebrospinal fluid or phosphate-buffered saline (PBS).

23. The pharmaceutical composition of claim 21, wherein the pharmaceutical composition consists essentially of the modified oligonucleotide and artificial cerebrospinal fluid.

24. The pharmaceutical composition of claim 21, wherein the pharmaceutical composition consists essentially of the modified oligonucleotide and PBS.

25. An oligomeric compound comprising a modified oligonucleotide according to the following chemical notation:

(SEQ ID NO: 2163)

$T_{es}G_{eo}T_{eo}A_{eo}G_{eo}T_{ds}A_{ds}{}^{m}C_{ds}A_{ds}A_{ds}A_{ds}T_{ds}{}^{m}C_{ds}T_{ds}T_{ds}T_{eo}$ ${}^{m}C_{eo}{}^{m}C_{es}T_{es}T_{e}$, wherein:

A=an adenine nucleobase, $^{m}$C=a 5-methylcytosine nucleobase,

G=a guanine nucleobase,

T=a thymine nucleobase, e=a 2'-MOE sugar moiety, d=a 2'-β-D-deoxyribosyl sugar moiety, s=a phosphorothioate internucleoside linkage, and o=a phosphodiester internucleoside linkage.

26. A population of oligomeric compounds of claim 25, wherein all of the phosphorothioate internucleoside linkages of the modified oligonucleotide are stereorandom.

27. A pharmaceutical composition comprising the oligomeric compound of claim 25, and a pharmaceutically acceptable diluent.

28. A pharmaceutical composition comprising the population of oligomeric compounds of claim 26, and a pharmaceutically acceptable diluent.

29. The pharmaceutical composition of claim 27, wherein the pharmaceutically acceptable diluent is artificial cerebrospinal fluid or phosphate-buffered saline (PBS).

30. The pharmaceutical composition of claim 28, wherein the pharmaceutically acceptable diluent is artificial cerebrospinal fluid or phosphate-buffered saline (PBS).

31. The pharmaceutical composition of claim 29, wherein the pharmaceutical composition consists essentially of the oligomeric compound and artificial cerebrospinal fluid.

32. The pharmaceutical composition of claim 29, wherein the pharmaceutical composition consists essentially of the oligomeric compound and PBS.

* * * * *